United States Patent 11,452,738 (TREATMENT OF THYMIC STROMAL LYMPHOPOIETIN (TSLP) RELATED DISEASES BY INHIBITION OF LONG-FORM TSLP TRANSCRIPTS) - sequence listing, part 2

SEQ ID NO: 22962 - RNA, 21 nt, Artificial Sequence
  Description of Artificial Sequence: Synthetic oligonucleotide
cugaccucuucucucugaauu

SEQ ID NO: 22963 - RNA, 21 nt, Artificial Sequence
  Description of Artificial Sequence: Synthetic oligonucleotide
ugaccucuucucucugacauu

SEQ ID NO: 22964 - RNA, 21 nt, Artificial Sequence
  Description of Artificial Sequence: Synthetic oligonucleotide
gaccucuucucucugacuauu

SEQ ID NO: 22965 - RNA, 21 nt, Artificial Sequence
  Description of Artificial Sequence: Synthetic oligonucleotide
accucuucucucugacucauu

SEQ ID NO: 22966 - RNA, 21 nt, Artificial Sequence
  Description of Artificial Sequence: Synthetic oligonucleotide
ccucuucucucugacucuauu

SEQ ID NO: 22967 - RNA, 21 nt, Artificial Sequence
  Description of Artificial Sequence: Synthetic oligonucleotide
cucuucucucugacucucauu

SEQ ID NO: 22968 - RNA, 21 nt, Artificial Sequence
  Description of Artificial Sequence: Synthetic oligonucleotide
ucuucucucugacucucgauu

SEQ ID NO: 22969 - RNA, 21 nt, Artificial Sequence
  Description of Artificial Sequence: Synthetic oligonucleotide
cuucucucugacucucgaauu

SEQ ID NO: 22970 - RNA, 21 nt, Artificial Sequence
  Description of Artificial Sequence: Synthetic oligonucleotide
uucucucugacucucgacauu

SEQ ID NO: 22971 - RNA, 21 nt, Artificial Sequence
  Description of Artificial Sequence: Synthetic oligonucleotide
ucucucugacucucgacuauu

SEQ ID NO: 22972 - RNA, 21 nt, Artificial Sequence
  Description of Artificial Sequence: Synthetic oligonucleotide
cucucugacucucgacuuauu

SEQ ID NO: 22973 - RNA, 21 nt, Artificial Sequence
  Description of Artificial Sequence: Synthetic oligonucleotide
ucucugacucucgacuugauu

SEQ ID NO: 22974 - RNA, 21 nt, Artificial Sequence
  Description of Artificial Sequence: Synthetic oligonucleotide
cucugacucucgacuuguauu

SEQ ID NO: 22975 - RNA, 21 nt, Artificial Sequence
  Description of Artificial Sequence: Synthetic oligonucleotide
ucugacucucgacuugugauu

SEQ ID NO: 22976 - RNA, 21 nt, Artificial Sequence
  Description of Artificial Sequence: Synthetic oligonucleotide
cugacucucgacuuguguauu

SEQ ID NO: 22977 - RNA, 21 nt, Artificial Sequence
  Description of Artificial Sequence: Synthetic oligonucleotide
ugacucucgacuuguguuauu

SEQ ID NO: 22978 - RNA, 21 nt, Artificial Sequence
  Description of Artificial Sequence: Synthetic oligonucleotide
gacucucgacuuguguucauu

SEQ ID NO: 22979 - RNA, 21 nt, Artificial Sequence
  Description of Artificial Sequence: Synthetic oligonucleotide
acucucgacuuguguuccauu

SEQ ID NO: 22980 - RNA, 21 nt, Artificial Sequence
  Description of Artificial Sequence: Synthetic oligonucleotide
cucucgacuuguguucccauu

SEQ ID NO: 22981 - RNA, 21 nt, Artificial Sequence
  Description of Artificial Sequence: Synthetic oligonucleotide
ucucgacuuguguuccccauu

SEQ ID NO: 22982 - RNA, 21 nt, Artificial Sequence
  Description of Artificial Sequence: Synthetic oligonucleotide
cucgacuuguguuccccgauu

SEQ ID NO: 22983 - RNA, 21 nt, Artificial Sequence
  Description of Artificial Sequence: Synthetic oligonucleotide
ucgacuuguguuccccgcauu

SEQ ID NO: 22984 - RNA, 21 nt, Artificial Sequence
  Description of Artificial Sequence: Synthetic oligonucleotide
cgacuuguguuccccgcuauu

SEQ ID NO: 22985 - RNA, 21 nt, Artificial Sequence
  Description of Artificial Sequence: Synthetic oligonucleotide
gacuuguguuccccgcucauu

SEQ ID NO: 22986 - RNA, 21 nt, Artificial Sequence
  Description of Artificial Sequence: Synthetic oligonucleotide
acuuguguuccccgcuccauu

SEQ ID NO: 22987 - RNA, 21 nt, Artificial Sequence
  Description of Artificial Sequence: Synthetic oligonucleotide
cuuguguuccccgcuccuauu

SEQ ID NO: 22988 - RNA, 21 nt, Artificial Sequence
  Description of Artificial Sequence: Synthetic oligonucleotide
uuguguuccccgcuccucauu

SEQ ID NO: 22989 - RNA, 21 nt, Artificial Sequence
  Description of Artificial Sequence: Synthetic oligonucleotide
uguguuccccgcuccuccauu

SEQ ID NO: 22990 - RNA, 21 nt, Artificial Sequence
  Description of Artificial Sequence: Synthetic oligonucleotide
guguuccccgcuccucccauu

SEQ ID NO: 22991 - RNA, 21 nt, Artificial Sequence
  Description of Artificial Sequence: Synthetic oligonucleotide
uguuccccgcuccucccuauu

SEQ ID NO: 22992 - RNA, 21 nt, Artificial Sequence
  Description of Artificial Sequence: Synthetic oligonucleotide
guuccccgcuccucccugauu

SEQ ID NO: 22993 - RNA, 21 nt, Artificial Sequence
  Description of Artificial Sequence: Synthetic oligonucleotide
uuccccgcuccucccugaauu

SEQ ID NO: 22994 - RNA, 21 nt, Artificial Sequence
  Description of Artificial Sequence: Synthetic oligonucleotide
uccccgcuccucccugacauu

SEQ ID NO: 22995 - RNA, 21 nt, Artificial Sequence
  Description of Artificial Sequence: Synthetic oligonucleotide
ccccgcuccucccugaccauu

SEQ ID NO: 22996 - RNA, 21 nt, Artificial Sequence
  Description of Artificial Sequence: Synthetic oligonucleotide
cccgcuccucccugaccuauu

SEQ ID NO: 22997 - RNA, 21 nt, Artificial Sequence
  Description of Artificial Sequence: Synthetic oligonucleotide
ccgcuccucccugaccuuauu

SEQ ID NO: 22998 - RNA, 21 nt, Artificial Sequence
  Description of Artificial Sequence: Synthetic oligonucleotide
cgcuccucccugaccuucauu

SEQ ID NO: 22999 - RNA, 21 nt, Artificial Sequence
  Description of Artificial Sequence: Synthetic oligonucleotide
gcuccucccugaccuuccauu

SEQ ID NO: 23000 - RNA, 21 nt, Artificial Sequence
  Description of Artificial Sequence: Synthetic oligonucleotide
cuccucccugaccuuccuauu

SEQ ID NO: 23001 - RNA, 21 nt, Artificial Sequence
  Description of Artificial Sequence: Synthetic oligonucleotide
uccucccugaccuuccucauu

SEQ ID NO: 23002 - RNA, 21 nt, Artificial Sequence
  Description of Artificial Sequence: Synthetic oligonucleotide
ccucccugaccuuccuccauu

SEQ ID NO: 23003 - RNA, 21 nt, Artificial Sequence
  Description of Artificial Sequence: Synthetic oligonucleotide
cucccugaccuuccucccauu

SEQ ID NO: 23004 - RNA, 21 nt, Artificial Sequence
  Description of Artificial Sequence: Synthetic oligonucleotide
ucccugaccuuccuccccauu

SEQ ID NO: 23005 - RNA, 21 nt, Artificial Sequence
  Description of Artificial Sequence: Synthetic oligonucleotide
cccugaccuuccuccccuauu

SEQ ID NO: 23006 - RNA, 21 nt, Artificial Sequence
  Description of Artificial Sequence: Synthetic oligonucleotide
ccugaccuuccuccccucauu

SEQ ID NO: 23007 - RNA, 21 nt, Artificial Sequence
  Description of Artificial Sequence: Synthetic oligonucleotide
cugaccuuccuccccuccauu

SEQ ID NO: 23008 - RNA, 21 nt, Artificial Sequence
  Description of Artificial Sequence: Synthetic oligonucleotide
ugaccuuccuccccucccauu

SEQ ID NO: 23009 - RNA, 21 nt, Artificial Sequence
  Description of Artificial Sequence: Synthetic oligonucleotide
gaccuuccuccccuccccauu

SEQ ID NO: 23010 - RNA, 21 nt, Artificial Sequence
  Description of Artificial Sequence: Synthetic oligonucleotide
accuuccuccccuccccuauu

SEQ ID NO: 23011 - RNA, 21 nt, Artificial Sequence
  Description of Artificial Sequence: Synthetic oligonucleotide
ccuuccuccccuccccuuauu

SEQ ID NO: 23012 - RNA, 21 nt, Artificial Sequence
  Description of Artificial Sequence: Synthetic oligonucleotide
cuuccuccccuccccuuuauu

SEQ ID NO: 23013 - RNA, 21 nt, Artificial Sequence
  Description of Artificial Sequence: Synthetic oligonucleotide
uuccuccccuccccuuucauu

SEQ ID NO: 23014 - RNA, 21 nt, Artificial Sequence
  Description of Artificial Sequence: Synthetic oligonucleotide
uccuccccuccccuuucaauu

SEQ ID NO: 23015 - RNA, 21 nt, Artificial Sequence
  Description of Artificial Sequence: Synthetic oligonucleotide
ccuccccuccccuuucacauu

SEQ ID NO: 23016 - RNA, 21 nt, Artificial Sequence
  Description of Artificial Sequence: Synthetic oligonucleotide
cuccccuccccuuucacuauu

SEQ ID NO: 23017 - RNA, 21 nt, Artificial Sequence
  Description of Artificial Sequence: Synthetic oligonucleotide
uccccuccccuuucacucauu

SEQ ID NO: 23018 - RNA, 21 nt, Artificial Sequence
  Description of Artificial Sequence: Synthetic oligonucleotide
ccccuccccuuucacucaauu

SEQ ID NO: 23019 - RNA, 21 nt, Artificial Sequence
  Description of Artificial Sequence: Synthetic oligonucleotide
cccuccccuuucacucaaauu

SEQ ID NO: 23020 - RNA, 21 nt, Artificial Sequence
  Description of Artificial Sequence: Synthetic oligonucleotide
ccuccccuuucacucaauauu

SEQ ID NO: 23021 - RNA, 21 nt, Artificial Sequence
  Description of Artificial Sequence: Synthetic oligonucleotide
cuccccuuucacucaauuauu

SEQ ID NO: 23022 - RNA, 21 nt, Artificial Sequence
  Description of Artificial Sequence: Synthetic oligonucleotide
uccccuuucacucaauucauu

SEQ ID NO: 23023 - RNA, 21 nt, Artificial Sequence
  Description of Artificial Sequence: Synthetic oligonucleotide
ccccuuucacucaauucuauu

SEQ ID NO: 23024 - RNA, 21 nt, Artificial Sequence
  Description of Artificial Sequence: Synthetic oligonucleotide
cccuuucacucaauucucauu

SEQ ID NO: 23025 - RNA, 21 nt, Artificial Sequence
  Description of Artificial Sequence: Synthetic oligonucleotide
ccuuucacucaauucucaauu

SEQ ID NO: 23026 - RNA, 21 nt, Artificial Sequence
  Description of Artificial Sequence: Synthetic oligonucleotide
cuuucacucaauucucacauu

SEQ ID NO: 23027 - RNA, 21 nt, Artificial Sequence
  Description of Artificial Sequence: Synthetic oligonucleotide
uuucacucaauucucaccauu

SEQ ID NO: 23028 - RNA, 21 nt, Artificial Sequence
  Description of Artificial Sequence: Synthetic oligonucleotide
uucacucaauucucaccaauu

SEQ ID NO: 23029 - RNA, 21 nt, Artificial Sequence
  Description of Artificial Sequence: Synthetic oligonucleotide
ucacucaauucucaccaaauu

SEQ ID NO: 23030 - RNA, 21 nt, Artificial Sequence
  Description of Artificial Sequence: Synthetic oligonucleotide
cacucaauucucaccaacauu

SEQ ID NO: 23031 - RNA, 21 nt, Artificial Sequence
  Description of Artificial Sequence: Synthetic oligonucleotide
acucaauucucaccaacuauu

SEQ ID NO: 23032 - RNA, 21 nt, Artificial Sequence
  Description of Artificial Sequence: Synthetic oligonucleotide
cucaauucucaccaacucauu

SEQ ID NO: 23033 - RNA, 21 nt, Artificial Sequence
  Description of Artificial Sequence: Synthetic oligonucleotide
ucaauucucaccaacucuauu

SEQ ID NO: 23034 - RNA, 21 nt, Artificial Sequence
  Description of Artificial Sequence: Synthetic oligonucleotide
caauucucaccaacucuuauu

SEQ ID NO: 23035 - RNA, 21 nt, Artificial Sequence
  Description of Artificial Sequence: Synthetic oligonucleotide
aauucucaccaacucuuuauu

SEQ ID NO: 23036 - RNA, 21 nt, Artificial Sequence
  Description of Artificial Sequence: Synthetic oligonucleotide
auucucaccaacucuuucauu

SEQ ID NO: 23037 - RNA, 21 nt, Artificial Sequence
  Description of Artificial Sequence: Synthetic oligonucleotide
uucucaccaacucuuucuauu

SEQ ID NO: 23038 - RNA, 21 nt, Artificial Sequence
  Description of Artificial Sequence: Synthetic oligonucleotide
ucucaccaacucuuucucauu

SEQ ID NO: 23039 - RNA, 21 nt, Artificial Sequence
  Description of Artificial Sequence: Synthetic oligonucleotide
cucaccaacucuuucucuauu

SEQ ID NO: 23040 - RNA, 21 nt, Artificial Sequence
  Description of Artificial Sequence: Synthetic oligonucleotide
ucaccaacucuuucucucauu

SEQ ID NO: 23041 - RNA, 21 nt, Artificial Sequence
  Description of Artificial Sequence: Synthetic oligonucleotide
caccaacucuuucucucuauu

SEQ ID NO: 23042 - RNA, 21 nt, Artificial Sequence
  Description of Artificial Sequence: Synthetic oligonucleotide
accaacucuuucucucucauu

SEQ ID NO: 23043 - RNA, 21 nt, Artificial Sequence
  Description of Artificial Sequence: Synthetic oligonucleotide
ccaacucuuucucucucuauu

SEQ ID NO: 23044 - RNA, 21 nt, Artificial Sequence
  Description of Artificial Sequence: Synthetic oligonucleotide
caacucuuucucucucugauu

SEQ ID NO: 23045 - RNA, 21 nt, Artificial Sequence
  Description of Artificial Sequence: Synthetic oligonucleotide
aacucuuucucucucuggauu

SEQ ID NO: 23046 - RNA, 21 nt, Artificial Sequence
  Description of Artificial Sequence: Synthetic oligonucleotide
acucuuucucucucugguauu

SEQ ID NO: 23047 - RNA, 21 nt, Artificial Sequence
  Description of Artificial Sequence: Synthetic oligonucleotide
cucuuucucucucuggugauu

SEQ ID NO: 23048 - RNA, 21 nt, Artificial Sequence
  Description of Artificial Sequence: Synthetic oligonucleotide
ucuuucucucucugguguauu

SEQ ID NO: 23049 - RNA, 21 nt, Artificial Sequence
  Description of Artificial Sequence: Synthetic oligonucleotide
cuuucucucucugguguuauu

SEQ ID NO: 23050 - RNA, 21 nt, Artificial Sequence
  Description of Artificial Sequence: Synthetic oligonucleotide
uuucucucucugguguuuauu

SEQ ID NO: 23051 - RNA, 21 nt, Artificial Sequence
  Description of Artificial Sequence: Synthetic oligonucleotide
uucucucucugguguuuuauu

SEQ ID NO: 23052 - RNA, 21 nt, Artificial Sequence
  Description of Artificial Sequence: Synthetic oligonucleotide
ucucucucugguguuuucauu

SEQ ID NO: 23053 - RNA, 21 nt, Artificial Sequence
  Description of Artificial Sequence: Synthetic oligonucleotide
cucucucugguguuuucuauu

SEQ ID NO: 23054 - RNA, 21 nt, Artificial Sequence
  Description of Artificial Sequence: Synthetic oligonucleotide
ucucucugguguuuucucauu

SEQ ID NO: 23055 - RNA, 21 nt, Artificial Sequence
  Description of Artificial Sequence: Synthetic oligonucleotide
cucucugguguuuucuccauu

SEQ ID NO: 23056 - RNA, 21 nt, Artificial Sequence
  Description of Artificial Sequence: Synthetic oligonucleotide
ucucugguguuuucuccuauu

SEQ ID NO: 23057 - RNA, 21 nt, Artificial Sequence
  Description of Artificial Sequence: Synthetic oligonucleotide
cucugguguuuucuccuuauu

SEQ ID NO: 23058 - RNA, 21 nt, Artificial Sequence
  Description of Artificial Sequence: Synthetic oligonucleotide
ucugguguuuucuccuuuauu

SEQ ID NO: 23059 - RNA, 21 nt, Artificial Sequence
  Description of Artificial Sequence: Synthetic oligonucleotide
cugguguuuucuccuuuuauu

SEQ ID NO: 23060 - RNA, 21 nt, Artificial Sequence
  Description of Artificial Sequence: Synthetic oligonucleotide
ugguguuuucuccuuuucauu

SEQ ID NO: 23061 - RNA, 21 nt, Artificial Sequence
  Description of Artificial Sequence: Synthetic oligonucleotide
gguguuuucuccuuuucuauu

SEQ ID NO: 23062 - RNA, 21 nt, Artificial Sequence
  Description of Artificial Sequence: Synthetic oligonucleotide
guguuuucuccuuuucucauu

SEQ ID NO: 23063 - RNA, 21 nt, Artificial Sequence
  Description of Artificial Sequence: Synthetic oligonucleotide
uguuuucuccuuuucucgauu

SEQ ID NO: 23064 - RNA, 21 nt, Artificial Sequence
  Description of Artificial Sequence: Synthetic oligonucleotide
guuuucuccuuuucucguauu

SEQ ID NO: 23065 - RNA, 21 nt, Artificial Sequence
  Description of Artificial Sequence: Synthetic oligonucleotide
uuuucuccuuuucucguaauu

SEQ ID NO: 23066 - RNA, 21 nt, Artificial Sequence
  Description of Artificial Sequence: Synthetic oligonucleotide
uuucuccuuuucucguaaauu

SEQ ID NO: 23067 - RNA, 21 nt, Artificial Sequence
  Description of Artificial Sequence: Synthetic oligonucleotide
uucuccuuuucucguaaaauu

SEQ ID NO: 23068 - RNA, 21 nt, Artificial Sequence
  Description of Artificial Sequence: Synthetic oligonucleotide
ucuccuuuucucguaaacauu

SEQ ID NO: 23069 - RNA, 21 nt, Artificial Sequence
  Description of Artificial Sequence: Synthetic oligonucleotide
cuccuuuucucguaaacuauu

SEQ ID NO: 23070 - RNA, 21 nt, Artificial Sequence
  Description of Artificial Sequence: Synthetic oligonucleotide
uccuuuucucguaaacuuauu

SEQ ID NO: 23071 - RNA, 21 nt, Artificial Sequence
  Description of Artificial Sequence: Synthetic oligonucleotide
ccuuuucucguaaacuuuauu

SEQ ID NO: 23072 - RNA, 21 nt, Artificial Sequence
  Description of Artificial Sequence: Synthetic oligonucleotide
cuuuucucguaaacuuugauu

SEQ ID NO: 23073 - RNA, 21 nt, Artificial Sequence
  Description of Artificial Sequence: Synthetic oligonucleotide
uuuucucguaaacuuugcauu

SEQ ID NO: 23074 - RNA, 21 nt, Artificial Sequence
  Description of Artificial Sequence: Synthetic oligonucleotide
uuucucguaaacuuugccauu

SEQ ID NO: 23075 - RNA, 21 nt, Artificial Sequence
  Description of Artificial Sequence: Synthetic oligonucleotide
uucucguaaacuuugccgauu

SEQ ID NO: 23076 - RNA, 21 nt, Artificial Sequence
  Description of Artificial Sequence: Synthetic oligonucleotide
ucucguaaacuuugccgcauu

SEQ ID NO: 23077 - RNA, 21 nt, Artificial Sequence
  Description of Artificial Sequence: Synthetic oligonucleotide
cucguaaacuuugccgccauu

SEQ ID NO: 23078 - RNA, 21 nt, Artificial Sequence
  Description of Artificial Sequence: Synthetic oligonucleotide
ucguaaacuuugccgccuauu

SEQ ID NO: 23079 - RNA, 21 nt, Artificial Sequence
  Description of Artificial Sequence: Synthetic oligonucleotide
cguaaacuuugccgccuaauu

SEQ ID NO: 23080 - RNA, 21 nt, Artificial Sequence
  Description of Artificial Sequence: Synthetic oligonucleotide
guaaacuuugccgccuauauu

SEQ ID NO: 23081 - RNA, 21 nt, Artificial Sequence
  Description of Artificial Sequence: Synthetic oligonucleotide
uaaacuuugccgccuaugauu

SEQ ID NO: 23082 - RNA, 21 nt, Artificial Sequence
  Description of Artificial Sequence: Synthetic oligonucleotide
aaacuuugccgccuaugaauu

SEQ ID NO: 23083 - RNA, 21 nt, Artificial Sequence
  Description of Artificial Sequence: Synthetic oligonucleotide
aacuuugccgccuaugagauu

SEQ ID NO: 23084 - RNA, 21 nt, Artificial Sequence
  Description of Artificial Sequence: Synthetic oligonucleotide
acuuugccgccuaugagcauu

SEQ ID NO: 23085 - RNA, 21 nt, Artificial Sequence
  Description of Artificial Sequence: Synthetic oligonucleotide
cuuugccgccuaugagcaauu

SEQ ID NO: 23086 - RNA, 21 nt, Artificial Sequence
  Description of Artificial Sequence: Synthetic oligonucleotide
uuugccgccuaugagcagauu

SEQ ID NO: 23087 - RNA, 21 nt, Artificial Sequence
  Description of Artificial Sequence: Synthetic oligonucleotide
uugccgccuaugagcagcauu

SEQ ID NO: 23088 - RNA, 21 nt, Artificial Sequence
  Description of Artificial Sequence: Synthetic oligonucleotide
ugccgccuaugagcagccauu

SEQ ID NO: 23089 - RNA, 21 nt, Artificial Sequence
  Description of Artificial Sequence: Synthetic oligonucleotide
gccgccuaugagcagccaauu

SEQ ID NO: 23090 - RNA, 21 nt, Artificial Sequence
  Description of Artificial Sequence: Synthetic oligonucleotide
ccgccuaugagcagccacauu

SEQ ID NO: 23091 - RNA, 21 nt, Artificial Sequence
  Description of Artificial Sequence: Synthetic oligonucleotide
cgccuaugagcagccacaauu

SEQ ID NO: 23092 - RNA, 21 nt, Artificial Sequence
  Description of Artificial Sequence: Synthetic oligonucleotide
gccuaugagcagccacauauu

SEQ ID NO: 23093 - RNA, 21 nt, Artificial Sequence
  Description of Artificial Sequence: Synthetic oligonucleotide
ccuaugagcagccacauuauu

SEQ ID NO: 23094 - RNA, 21 nt, Artificial Sequence
  Description of Artificial Sequence: Synthetic oligonucleotide
cuaugagcagccacauugauu

SEQ ID NO: 23095 - RNA, 21 nt, Artificial Sequence
  Description of Artificial Sequence: Synthetic oligonucleotide
uaugagcagccacauugcauu

SEQ ID NO: 23096 - RNA, 21 nt, Artificial Sequence
  Description of Artificial Sequence: Synthetic oligonucleotide
augagcagccacauugccauu

SEQ ID NO: 23097 - RNA, 21 nt, Artificial Sequence
  Description of Artificial Sequence: Synthetic oligonucleotide
ugagcagccacauugccuauu

SEQ ID NO: 23098 - RNA, 21 nt, Artificial Sequence
  Description of Artificial Sequence: Synthetic oligonucleotide
gagcagccacauugccuuauu

SEQ ID NO: 23099 - RNA, 21 nt, Artificial Sequence
  Description of Artificial Sequence: Synthetic oligonucleotide
agcagccacauugccuuaauu

SEQ ID NO: 23100 - RNA, 21 nt, Artificial Sequence
  Description of Artificial Sequence: Synthetic oligonucleotide
gcagccacauugccuuacauu

SEQ ID NO: 23101 - RNA, 21 nt, Artificial Sequence
  Description of Artificial Sequence: Synthetic oligonucleotide
cagccacauugccuuacuauu

SEQ ID NO: 23102 - RNA, 21 nt, Artificial Sequence
  Description of Artificial Sequence: Synthetic oligonucleotide
agccacauugccuuacugauu

SEQ ID NO: 23103 - RNA, 21 nt, Artificial Sequence
  Description of Artificial Sequence: Synthetic oligonucleotide
acccucgccacgccccugauu

SEQ ID NO: 23104 - RNA, 21 nt, Artificial Sequence
  Description of Artificial Sequence: Synthetic oligonucleotide
cccucgccacgccccugcauu

SEQ ID NO: 23105 - RNA, 21 nt, Artificial Sequence
  Description of Artificial Sequence: Synthetic oligonucleotide
ccucgccacgccccugcuauu

SEQ ID NO: 23106 - RNA, 21 nt, Artificial Sequence
  Description of Artificial Sequence: Synthetic oligonucleotide
cucgccacgccccugcucauu

SEQ ID NO: 23107 - RNA, 21 nt, Artificial Sequence
  Description of Artificial Sequence: Synthetic oligonucleotide
ucgccacgccccugcuccauu

SEQ ID NO: 23108 - RNA, 21 nt, Artificial Sequence
  Description of Artificial Sequence: Synthetic oligonucleotide
cgccacgccccugcucccauu

SEQ ID NO: 23109 - RNA, 21 nt, Artificial Sequence
  Description of Artificial Sequence: Synthetic oligonucleotide
gccacgccccugcuccccauu

SEQ ID NO: 23110 - RNA, 21 nt, Artificial Sequence
  Description of Artificial Sequence: Synthetic oligonucleotide
ccacgccccugcucccccauu

SEQ ID NO: 23111 - RNA, 21 nt, Artificial Sequence
  Description of Artificial Sequence: Synthetic oligonucleotide
cacgccccugcucccccgauu

SEQ ID NO: 23112 - RNA, 21 nt, Artificial Sequence
  Description of Artificial Sequence: Synthetic oligonucleotide
acgccccugcucccccgcauu

SEQ ID NO: 23113 - RNA, 21 nt, Artificial Sequence
  Description of Artificial Sequence: Synthetic oligonucleotide
cgccccugcucccccgcgauu

SEQ ID NO: 23114 - RNA, 21 nt, Artificial Sequence
  Description of Artificial Sequence: Synthetic oligonucleotide
gccccugcucccccgcggauu

SEQ ID NO: 23115 - RNA, 21 nt, Artificial Sequence
  Description of Artificial Sequence: Synthetic oligonucleotide
ccccugcucccccgcgguauu

SEQ ID NO: 23116 - RNA, 21 nt, Artificial Sequence
  Description of Artificial Sequence: Synthetic oligonucleotide
cccugcucccccgcgguuauu

SEQ ID NO: 23117 - RNA, 21 nt, Artificial Sequence
  Description of Artificial Sequence: Synthetic oligonucleotide
ccugcucccccgcgguugauu

SEQ ID NO: 23118 - RNA, 21 nt, Artificial Sequence
  Description of Artificial Sequence: Synthetic oligonucleotide
cugcucccccgcgguuggauu

SEQ ID NO: 23119 - RNA, 21 nt, Artificial Sequence
  Description of Artificial Sequence: Synthetic oligonucleotide
ugcucccccgcgguugguauu

SEQ ID NO: 23120 - RNA, 21 nt, Artificial Sequence
  Description of Artificial Sequence: Synthetic oligonucleotide
gcucccccgcgguugguuauu

SEQ ID NO: 23121 - RNA, 21 nt, Artificial Sequence
  Description of Artificial Sequence: Synthetic oligonucleotide
cucccccgcgguugguucauu

SEQ ID NO: 23122 - RNA, 21 nt, Artificial Sequence
  Description of Artificial Sequence: Synthetic oligonucleotide
ucccccgcgguugguucuauu

SEQ ID NO: 23123 - RNA, 21 nt, Artificial Sequence
  Description of Artificial Sequence: Synthetic oligonucleotide
cccccgcgguugguucuuauu

SEQ ID NO: 23124 - RNA, 21 nt, Artificial Sequence
  Description of Artificial Sequence: Synthetic oligonucleotide
ccccgcgguugguucuucauu

SEQ ID NO: 23125 - RNA, 21 nt, Artificial Sequence
  Description of Artificial Sequence: Synthetic oligonucleotide
cccgcgguugguucuuccauu

SEQ ID NO: 23126 - RNA, 21 nt, Artificial Sequence
  Description of Artificial Sequence: Synthetic oligonucleotide
ccgcgguugguucuuccuauu

SEQ ID NO: 23127 - RNA, 21 nt, Artificial Sequence
  Description of Artificial Sequence: Synthetic oligonucleotide
cgcgguugguucuuccuuauu

SEQ ID NO: 23128 - RNA, 21 nt, Artificial Sequence
  Description of Artificial Sequence: Synthetic oligonucleotide
gcgguugguucuuccuugauu

SEQ ID NO: 23129 - RNA, 21 nt, Artificial Sequence
  Description of Artificial Sequence: Synthetic oligonucleotide
cgguugguucuuccuugcauu

SEQ ID NO: 23130 - RNA, 21 nt, Artificial Sequence
  Description of Artificial Sequence: Synthetic oligonucleotide
gguugguucuuccuugcuauu

SEQ ID NO: 23131 - RNA, 21 nt, Artificial Sequence
  Description of Artificial Sequence: Synthetic oligonucleotide
guugguucuuccuugcucauu

SEQ ID NO: 23132 - RNA, 21 nt, Artificial Sequence
  Description of Artificial Sequence: Synthetic oligonucleotide
uugguucuuccuugcucuauu

SEQ ID NO: 23133 - RNA, 21 nt, Artificial Sequence
  Description of Artificial Sequence: Synthetic oligonucleotide
ugguucuuccuugcucuaauu

SEQ ID NO: 23134 - RNA, 21 nt, Artificial Sequence
  Description of Artificial Sequence: Synthetic oligonucleotide
gguucuuccuugcucuacauu

SEQ ID NO: 23135 - RNA, 21 nt, Artificial Sequence
  Description of Artificial Sequence: Synthetic oligonucleotide
guucuuccuugcucuacuauu

SEQ ID NO: 23136 - RNA, 21 nt, Artificial Sequence
  Description of Artificial Sequence: Synthetic oligonucleotide
uucuuccuugcucuacucauu

SEQ ID NO: 23137 - RNA, 21 nt, Artificial Sequence
  Description of Artificial Sequence: Synthetic oligonucleotide
ucuuccuugcucuacucaauu

SEQ ID NO: 23138 - RNA, 21 nt, Artificial Sequence
  Description of Artificial Sequence: Synthetic oligonucleotide
cuuccuugcucuacucaaauu

SEQ ID NO: 23139 - RNA, 21 nt, Artificial Sequence
  Description of Artificial Sequence: Synthetic oligonucleotide
uuccuugcucuacucaacauu

SEQ ID NO: 23140 - RNA, 21 nt, Artificial Sequence
  Description of Artificial Sequence: Synthetic oligonucleotide
uccuugcucuacucaaccauu

SEQ ID NO: 23141 - RNA, 21 nt, Artificial Sequence
  Description of Artificial Sequence: Synthetic oligonucleotide
ccuugcucuacucaacccauu

SEQ ID NO: 23142 - RNA, 21 nt, Artificial Sequence
  Description of Artificial Sequence: Synthetic oligonucleotide
cuugcucuacucaacccuauu

SEQ ID NO: 23143 - RNA, 21 nt, Artificial Sequence
  Description of Artificial Sequence: Synthetic oligonucleotide
uugcucuacucaacccugauu

SEQ ID NO: 23144 - RNA, 21 nt, Artificial Sequence
  Description of Artificial Sequence: Synthetic oligonucleotide
ugcucuacucaacccugaauu

SEQ ID NO: 23145 - RNA, 21 nt, Artificial Sequence
  Description of Artificial Sequence: Synthetic oligonucleotide
gcucuacucaacccugacauu

SEQ ID NO: 23146 - RNA, 21 nt, Artificial Sequence
  Description of Artificial Sequence: Synthetic oligonucleotide
cucuacucaacccugaccauu

SEQ ID NO: 23147 - RNA, 21 nt, Artificial Sequence
  Description of Artificial Sequence: Synthetic oligonucleotide
ucuacucaacccugaccuauu

SEQ ID NO: 23148 - RNA, 21 nt, Artificial Sequence
  Description of Artificial Sequence: Synthetic oligonucleotide
cuacucaacccugaccucauu

SEQ ID NO: 23149 - RNA, 21 nt, Artificial Sequence
  Description of Artificial Sequence: Synthetic oligonucleotide
uacucaacccugaccucuauu

SEQ ID NO: 23150 - RNA, 21 nt, Artificial Sequence
  Description of Artificial Sequence: Synthetic oligonucleotide
acucaacccugaccucuuauu

SEQ ID NO: 23151 - RNA, 21 nt, Artificial Sequence
  Description of Artificial Sequence: Synthetic oligonucleotide
cucaacccugaccucuucauu

SEQ ID NO: 23152 - RNA, 21 nt, Artificial Sequence
  Description of Artificial Sequence: Synthetic oligonucleotide
ucaacccugaccucuucuauu

SEQ ID NO: 23153 - RNA, 21 nt, Artificial Sequence
  Description of Artificial Sequence: Synthetic oligonucleotide
caacccugaccucuucucauu

SEQ ID NO: 23154 - RNA, 21 nt, Artificial Sequence
  Description of Artificial Sequence: Synthetic oligonucleotide
aacccugaccucuucucuauu

SEQ ID NO: 23155 - RNA, 21 nt, Artificial Sequence
  Description of Artificial Sequence: Synthetic oligonucleotide
acccugaccucuucucucauu

SEQ ID NO: 23156 - RNA, 21 nt, Artificial Sequence
  Description of Artificial Sequence: Synthetic oligonucleotide
cccugaccucuucucucuauu

SEQ ID NO: 23157 - RNA, 21 nt, Artificial Sequence
  Description of Artificial Sequence: Synthetic oligonucleotide
ccugaccucuucucucugauu

SEQ ID NO: 23158 - RNA, 21 nt, Artificial Sequence
  Description of Artificial Sequence: Synthetic oligonucleotide
cugaccucuucucucugaauu

SEQ ID NO: 23159 - RNA, 21 nt, Artificial Sequence
  Description of Artificial Sequence: Synthetic oligonucleotide
ugaccucuucucucugacauu

SEQ ID NO: 23160 - RNA, 21 nt, Artificial Sequence
  Description of Artificial Sequence: Synthetic oligonucleotide
gaccucuucucucugacuauu

SEQ ID NO: 23161 - RNA, 21 nt, Artificial Sequence
  Description of Artificial Sequence: Synthetic oligonucleotide
accucuucucucugacucauu

SEQ ID NO: 23162 - RNA, 21 nt, Artificial Sequence
  Description of Artificial Sequence: Synthetic oligonucleotide
ccucuucucucugacucuauu

SEQ ID NO: 23163 - RNA, 21 nt, Artificial Sequence
  Description of Artificial Sequence: Synthetic oligonucleotide
cucuucucucugacucucauu

SEQ ID NO: 23164 - RNA, 21 nt, Artificial Sequence
  Description of Artificial Sequence: Synthetic oligonucleotide
ucuucucucugacucucgauu

SEQ ID NO: 23165 - RNA, 21 nt, Artificial Sequence
  Description of Artificial Sequence: Synthetic oligonucleotide
cuucucucugacucucgaauu

SEQ ID NO: 23166 - RNA, 21 nt, Artificial Sequence
  Description of Artificial Sequence: Synthetic oligonucleotide
uucucucugacucucgacauu

SEQ ID NO: 23167 - RNA, 21 nt, Artificial Sequence
  Description of Artificial Sequence: Synthetic oligonucleotide
ucucucugacucucgacuauu

SEQ ID NO: 23168 - RNA, 21 nt, Artificial Sequence
  Description of Artificial Sequence: Synthetic oligonucleotide
cucucugacucucgacuuauu

SEQ ID NO: 23169 - RNA, 21 nt, Artificial Sequence
  Description of Artificial Sequence: Synthetic oligonucleotide
ucucugacucucgacuugauu

SEQ ID NO: 23170 - RNA, 21 nt, Artificial Sequence
  Description of Artificial Sequence: Synthetic oligonucleotide
cucugacucucgacuuguauu

SEQ ID NO: 23171 - RNA, 21 nt, Artificial Sequence
  Description of Artificial Sequence: Synthetic oligonucleotide
ucugacucucgacuugugauu

SEQ ID NO: 23172 - RNA, 21 nt, Artificial Sequence
  Description of Artificial Sequence: Synthetic oligonucleotide
cugacucucgacuuguguauu

SEQ ID NO: 23173 - RNA, 21 nt, Artificial Sequence
  Description of Artificial Sequence: Synthetic oligonucleotide
ugacucucgacuuguguuauu

SEQ ID NO: 23174 - RNA, 21 nt, Artificial Sequence
  Description of Artificial Sequence: Synthetic oligonucleotide
gacucucgacuuguguucauu

SEQ ID NO: 23175 - RNA, 21 nt, Artificial Sequence
  Description of Artificial Sequence: Synthetic oligonucleotide
acucucgacuuguguuccauu

SEQ ID NO: 23176 - RNA, 21 nt, Artificial Sequence
  Description of Artificial Sequence: Synthetic oligonucleotide
cucucgacuuguguucccauu

SEQ ID NO: 23177 - RNA, 21 nt, Artificial Sequence
  Description of Artificial Sequence: Synthetic oligonucleotide
ucucgacuuguguuccccauu

SEQ ID NO: 23178 - RNA, 21 nt, Artificial Sequence
  Description of Artificial Sequence: Synthetic oligonucleotide
cucgacuuguguuccccgauu

SEQ ID NO: 23179 - RNA, 21 nt, Artificial Sequence
  Description of Artificial Sequence: Synthetic oligonucleotide
ucgacuuguguuccccgcauu

SEQ ID NO: 23180 - RNA, 21 nt, Artificial Sequence
  Description of Artificial Sequence: Synthetic oligonucleotide
cgacuuguguuccccgcuauu

SEQ ID NO: 23181 - RNA, 21 nt, Artificial Sequence
  Description of Artificial Sequence: Synthetic oligonucleotide
gacuuguguuccccgcucauu

SEQ ID NO: 23182 - RNA, 21 nt, Artificial Sequence
  Description of Artificial Sequence: Synthetic oligonucleotide
acuuguguuccccgcuccauu

SEQ ID NO: 23183 - RNA, 21 nt, Artificial Sequence
  Description of Artificial Sequence: Synthetic oligonucleotide
cuuguguuccccgcuccuauu

SEQ ID NO: 23184 - RNA, 21 nt, Artificial Sequence
  Description of Artificial Sequence: Synthetic oligonucleotide
uuguguuccccgcuccucauu

SEQ ID NO: 23185 - RNA, 21 nt, Artificial Sequence
  Description of Artificial Sequence: Synthetic oligonucleotide
uguguuccccgcuccuccauu

SEQ ID NO: 23186 - RNA, 21 nt, Artificial Sequence
  Description of Artificial Sequence: Synthetic oligonucleotide
guguuccccgcuccucccauu

SEQ ID NO: 23187 - RNA, 21 nt, Artificial Sequence
  Description of Artificial Sequence: Synthetic oligonucleotide
uguuccccgcuccucccuauu

SEQ ID NO: 23188 - RNA, 21 nt, Artificial Sequence
  Description of Artificial Sequence: Synthetic oligonucleotide
guuccccgcuccucccugauu

SEQ ID NO: 23189 - RNA, 21 nt, Artificial Sequence
  Description of Artificial Sequence: Synthetic oligonucleotide
uuccccgcuccucccugaauu

SEQ ID NO: 23190 - RNA, 21 nt, Artificial Sequence
  Description of Artificial Sequence: Synthetic oligonucleotide
uccccgcuccucccugacauu

SEQ ID NO: 23191 - RNA, 21 nt, Artificial Sequence
  Description of Artificial Sequence: Synthetic oligonucleotide
ccccgcuccucccugaccauu

SEQ ID NO: 23192 - RNA, 21 nt, Artificial Sequence
  Description of Artificial Sequence: Synthetic oligonucleotide
cccgcuccucccugaccuauu

SEQ ID NO: 23193 - RNA, 21 nt, Artificial Sequence
  Description of Artificial Sequence: Synthetic oligonucleotide
ccgcuccucccugaccuuauu

SEQ ID NO: 23194 - RNA, 21 nt, Artificial Sequence
  Description of Artificial Sequence: Synthetic oligonucleotide
cgcuccucccugaccuucauu

SEQ ID NO: 23195 - RNA, 21 nt, Artificial Sequence
  Description of Artificial Sequence: Synthetic oligonucleotide
gcuccucccugaccuuccauu

SEQ ID NO: 23196 - RNA, 21 nt, Artificial Sequence
  Description of Artificial Sequence: Synthetic oligonucleotide
cuccucccugaccuuccuauu

SEQ ID NO: 23197 - RNA, 21 nt, Artificial Sequence
  Description of Artificial Sequence: Synthetic oligonucleotide
uccucccugaccuuccucauu

SEQ ID NO: 23198 - RNA, 21 nt, Artificial Sequence
  Description of Artificial Sequence: Synthetic oligonucleotide
ccucccugaccuuccuccauu

SEQ ID NO: 23199 - RNA, 21 nt, Artificial Sequence
  Description of Artificial Sequence: Synthetic oligonucleotide
cucccugaccuuccucccauu

SEQ ID NO: 23200 - RNA, 21 nt, Artificial Sequence
  Description of Artificial Sequence: Synthetic oligonucleotide
ucccugaccuuccuccccauu

SEQ ID NO: 23201 - RNA, 21 nt, Artificial Sequence
  Description of Artificial Sequence: Synthetic oligonucleotide
cccugaccuuccuccccuauu

SEQ ID NO: 23202 - RNA, 21 nt, Artificial Sequence
  Description of Artificial Sequence: Synthetic oligonucleotide
ccugaccuuccuccccucauu

SEQ ID NO: 23203 - RNA, 21 nt, Artificial Sequence
  Description of Artificial Sequence: Synthetic oligonucleotide
cugaccuuccuccccuccauu

SEQ ID NO: 23204 - RNA, 21 nt, Artificial Sequence
  Description of Artificial Sequence: Synthetic oligonucleotide
ugaccuuccuccccucccauu

SEQ ID NO: 23205 - RNA, 21 nt, Artificial Sequence
  Description of Artificial Sequence: Synthetic oligonucleotide
gaccuuccuccccuccccauu

SEQ ID NO: 23206 - RNA, 21 nt, Artificial Sequence
  Description of Artificial Sequence: Synthetic oligonucleotide
accuuccuccccuccccuauu

SEQ ID NO: 23207 - RNA, 21 nt, Artificial Sequence
  Description of Artificial Sequence: Synthetic oligonucleotide
ccuuccuccccuccccuuauu

SEQ ID NO: 23208 - RNA, 21 nt, Artificial Sequence
  Description of Artificial Sequence: Synthetic oligonucleotide
cuuccuccccuccccuuuauu

SEQ ID NO: 23209 - RNA, 21 nt, Artificial Sequence
  Description of Artificial Sequence: Synthetic oligonucleotide
uuccuccccuccccuuucauu

SEQ ID NO: 23210 - RNA, 21 nt, Artificial Sequence
  Description of Artificial Sequence: Synthetic oligonucleotide
uccuccccuccccuuucaauu

SEQ ID NO: 23211 - RNA, 21 nt, Artificial Sequence
  Description of Artificial Sequence: Synthetic oligonucleotide
ccuccccuccccuuucacauu

SEQ ID NO: 23212 - RNA, 21 nt, Artificial Sequence
  Description of Artificial Sequence: Synthetic oligonucleotide
cuccccuccccuuucacuauu

SEQ ID NO: 23213 - RNA, 21 nt, Artificial Sequence
  Description of Artificial Sequence: Synthetic oligonucleotide
uccccuccccuuucacucauu

SEQ ID NO: 23214 - RNA, 21 nt, Artificial Sequence
  Description of Artificial Sequence: Synthetic oligonucleotide
ccccuccccuuucacucaauu

SEQ ID NO: 23215 - RNA, 21 nt, Artificial Sequence
  Description of Artificial Sequence: Synthetic oligonucleotide
cccuccccuuucacucaaauu

SEQ ID NO: 23216 - RNA, 21 nt, Artificial Sequence
  Description of Artificial Sequence: Synthetic oligonucleotide
ccuccccuuucacucaauauu

SEQ ID NO: 23217 - RNA, 21 nt, Artificial Sequence
  Description of Artificial Sequence: Synthetic oligonucleotide
cuccccuuucacucaauuauu

SEQ ID NO: 23218 - RNA, 21 nt, Artificial Sequence
  Description of Artificial Sequence: Synthetic oligonucleotide
uccccuuucacucaauucauu

SEQ ID NO: 23219 - RNA, 21 nt, Artificial Sequence
  Description of Artificial Sequence: Synthetic oligonucleotide
ccccuuucacucaauucuauu

SEQ ID NO: 23220 - RNA, 21 nt, Artificial Sequence
  Description of Artificial Sequence: Synthetic oligonucleotide
cccuuucacucaauucucauu

SEQ ID NO: 23221 - RNA, 21 nt, Artificial Sequence
  Description of Artificial Sequence: Synthetic oligonucleotide
ccuuucacucaauucucaauu

SEQ ID NO: 23222 - RNA, 21 nt, Artificial Sequence
  Description of Artificial Sequence: Synthetic oligonucleotide
cuuucacucaauucucacauu

SEQ ID NO: 23223 - RNA, 21 nt, Artificial Sequence
  Description of Artificial Sequence: Synthetic oligonucleotide
uuucacucaauucucaccauu

SEQ ID NO: 23224 - RNA, 21 nt, Artificial Sequence
  Description of Artificial Sequence: Synthetic oligonucleotide
uucacucaauucucaccaauu

SEQ ID NO: 23225 - RNA, 21 nt, Artificial Sequence
  Description of Artificial Sequence: Synthetic oligonucleotide
ucacucaauucucaccaaauu

SEQ ID NO: 23226 - RNA, 21 nt, Artificial Sequence
  Description of Artificial Sequence: Synthetic oligonucleotide
cacucaauucucaccaacauu

SEQ ID NO: 23227 - RNA, 21 nt, Artificial Sequence
  Description of Artificial Sequence: Synthetic oligonucleotide
acucaauucucaccaacuauu

SEQ ID NO: 23228 - RNA, 21 nt, Artificial Sequence
  Description of Artificial Sequence: Synthetic oligonucleotide
cucaauucucaccaacucauu

SEQ ID NO: 23229 - RNA, 21 nt, Artificial Sequence
  Description of Artificial Sequence: Synthetic oligonucleotide
ucaauucucaccaacucuauu

SEQ ID NO: 23230 - RNA, 21 nt, Artificial Sequence
  Description of Artificial Sequence: Synthetic oligonucleotide
caauucucaccaacucuuauu

SEQ ID NO: 23231 - RNA, 21 nt, Artificial Sequence
  Description of Artificial Sequence: Synthetic oligonucleotide
aauucucaccaacucuuuauu

SEQ ID NO: 23232 - RNA, 21 nt, Artificial Sequence
  Description of Artificial Sequence: Synthetic oligonucleotide
auucucaccaacucuuucauu

SEQ ID NO: 23233 - RNA, 21 nt, Artificial Sequence
  Description of Artificial Sequence: Synthetic oligonucleotide
uucucaccaacucuuucuauu

SEQ ID NO: 23234 - RNA, 21 nt, Artificial Sequence
  Description of Artificial Sequence: Synthetic oligonucleotide
ucucaccaacucuuucucauu

SEQ ID NO: 23235 - RNA, 21 nt, Artificial Sequence
  Description of Artificial Sequence: Synthetic oligonucleotide
cucaccaacucuuucucuauu

SEQ ID NO: 23236 - RNA, 21 nt, Artificial Sequence
  Description of Artificial Sequence: Synthetic oligonucleotide
ucaccaacucuuucucucauu

SEQ ID NO: 23237 - RNA, 21 nt, Artificial Sequence
  Description of Artificial Sequence: Synthetic oligonucleotide
caccaacucuuucucucuauu

SEQ ID NO: 23238 - RNA, 21 nt, Artificial Sequence
  Description of Artificial Sequence: Synthetic oligonucleotide
accaacucuuucucucucauu

SEQ ID NO: 23239 - RNA, 21 nt, Artificial Sequence
  Description of Artificial Sequence: Synthetic oligonucleotide
ccaacucuuucucucucuauu

SEQ ID NO: 23240 - RNA, 21 nt, Artificial Sequence
  Description of Artificial Sequence: Synthetic oligonucleotide
caacucuuucucucucugauu

SEQ ID NO: 23241 - RNA, 21 nt, Artificial Sequence
  Description of Artificial Sequence: Synthetic oligonucleotide
aacucuuucucucucuggauu

SEQ ID NO: 23242 - RNA, 21 nt, Artificial Sequence
  Description of Artificial Sequence: Synthetic oligonucleotide
acucuuucucucucugguauu

SEQ ID NO: 23243 - RNA, 21 nt, Artificial Sequence
  Description of Artificial Sequence: Synthetic oligonucleotide
cucuuucucucucuggugauu

SEQ ID NO: 23244 - RNA, 21 nt, Artificial Sequence
  Description of Artificial Sequence: Synthetic oligonucleotide
ucuuucucucucugguguauu

SEQ ID NO: 23245 - RNA, 21 nt, Artificial Sequence
  Description of Artificial Sequence: Synthetic oligonucleotide
cuuucucucucugguguuauu

SEQ ID NO: 23246 - RNA, 21 nt, Artificial Sequence
  Description of Artificial Sequence: Synthetic oligonucleotide
uuucucucucugguguuuauu

SEQ ID NO: 23247 - RNA, 21 nt, Artificial Sequence
  Description of Artificial Sequence: Synthetic oligonucleotide
uucucucucugguguuuuauu

SEQ ID NO: 23248 - RNA, 21 nt, Artificial Sequence
  Description of Artificial Sequence: Synthetic oligonucleotide
ucucucucugguguuuucauu

SEQ ID NO: 23249 - RNA, 21 nt, Artificial Sequence
  Description of Artificial Sequence: Synthetic oligonucleotide
cucucucugguguuuucuauu

SEQ ID NO: 23250 - RNA, 21 nt, Artificial Sequence
  Description of Artificial Sequence: Synthetic oligonucleotide
ucucucugguguuuucucauu

SEQ ID NO: 23251 - RNA, 21 nt, Artificial Sequence
  Description of Artificial Sequence: Synthetic oligonucleotide
cucucugguguuuucuccauu

SEQ ID NO: 23252 - RNA, 21 nt, Artificial Sequence
  Description of Artificial Sequence: Synthetic oligonucleotide
ucucugguguuuucuccuauu

SEQ ID NO: 23253 - RNA, 21 nt, Artificial Sequence
  Description of Artificial Sequence: Synthetic oligonucleotide
cucugguguuuucuccuuauu

SEQ ID NO: 23254 - RNA, 21 nt, Artificial Sequence
  Description of Artificial Sequence: Synthetic oligonucleotide
ucugguguuuucuccuuuauu

SEQ ID NO: 23255 - RNA, 21 nt, Artificial Sequence
  Description of Artificial Sequence: Synthetic oligonucleotide
cugguguuuucuccuuuuauu

SEQ ID NO: 23256 - RNA, 21 nt, Artificial Sequence
  Description of Artificial Sequence: Synthetic oligonucleotide
ugguguuuucuccuuuucauu

SEQ ID NO: 23257 - RNA, 21 nt, Artificial Sequence
  Description of Artificial Sequence: Synthetic oligonucleotide
gguguuuucuccuuuucuauu

SEQ ID NO: 23258 - RNA, 21 nt, Artificial Sequence
  Description of Artificial Sequence: Synthetic oligonucleotide
guguuuucuccuuuucucauu

SEQ ID NO: 23259 - RNA, 21 nt, Artificial Sequence
  Description of Artificial Sequence: Synthetic oligonucleotide
uguuuucuccuuuucucgauu

SEQ ID NO: 23260 - RNA, 21 nt, Artificial Sequence
  Description of Artificial Sequence: Synthetic oligonucleotide
guuuucuccuuuucucguauu

SEQ ID NO: 23261 - RNA, 21 nt, Artificial Sequence
  Description of Artificial Sequence: Synthetic oligonucleotide
uuuucuccuuuucucguaauu

SEQ ID NO: 23262 - RNA, 21 nt, Artificial Sequence
  Description of Artificial Sequence: Synthetic oligonucleotide
uuucuccuuuucucguaaauu

SEQ ID NO: 23263 - RNA, 21 nt, Artificial Sequence
  Description of Artificial Sequence: Synthetic oligonucleotide
uucuccuuuucucguaaaauu

SEQ ID NO: 23264 - RNA, 21 nt, Artificial Sequence
  Description of Artificial Sequence: Synthetic oligonucleotide
ucuccuuuucucguaaacauu

SEQ ID NO: 23265 - RNA, 21 nt, Artificial Sequence
  Description of Artificial Sequence: Synthetic oligonucleotide
cuccuuuucucguaaacuauu

SEQ ID NO: 23266 - RNA, 21 nt, Artificial Sequence
  Description of Artificial Sequence: Synthetic oligonucleotide
uccuuuucucguaaacuuauu

SEQ ID NO: 23267 - RNA, 21 nt, Artificial Sequence
  Description of Artificial Sequence: Synthetic oligonucleotide
ccuuuucucguaaacuuuauu

SEQ ID NO: 23268 - RNA, 21 nt, Artificial Sequence
  Description of Artificial Sequence: Synthetic oligonucleotide
cuuuucucguaaacuuugauu

SEQ ID NO: 23269 - RNA, 21 nt, Artificial Sequence
  Description of Artificial Sequence: Synthetic oligonucleotide
uuuucucguaaacuuugcauu

SEQ ID NO: 23270 - RNA, 21 nt, Artificial Sequence
  Description of Artificial Sequence: Synthetic oligonucleotide
uuucucguaaacuuugccauu

SEQ ID NO: 23271 - RNA, 21 nt, Artificial Sequence
  Description of Artificial Sequence: Synthetic oligonucleotide
uucucguaaacuuugccgauu

SEQ ID NO: 23272 - RNA, 21 nt, Artificial Sequence
  Description of Artificial Sequence: Synthetic oligonucleotide
ucucguaaacuuugccgcauu

SEQ ID NO: 23273 - RNA, 21 nt, Artificial Sequence
  Description of Artificial Sequence: Synthetic oligonucleotide
cucguaaacuuugccgccauu

SEQ ID NO: 23274 - RNA, 21 nt, Artificial Sequence
  Description of Artificial Sequence: Synthetic oligonucleotide
ucguaaacuuugccgccuauu

SEQ ID NO: 23275 - RNA, 21 nt, Artificial Sequence
  Description of Artificial Sequence: Synthetic oligonucleotide
cguaaacuuugccgccuaauu

SEQ ID NO: 23276 - RNA, 21 nt, Artificial Sequence
  Description of Artificial Sequence: Synthetic oligonucleotide
guaaacuuugccgccuauauu

SEQ ID NO: 23277 - RNA, 21 nt, Artificial Sequence
  Description of Artificial Sequence: Synthetic oligonucleotide
uaaacuuugccgccuaugauu

SEQ ID NO: 23278 - RNA, 21 nt, Artificial Sequence
  Description of Artificial Sequence: Synthetic oligonucleotide
aaacuuugccgccuaugaauu

SEQ ID NO: 23279 - RNA, 21 nt, Artificial Sequence
  Description of Artificial Sequence: Synthetic oligonucleotide
aacuuugccgccuaugagauu

SEQ ID NO: 23280 - RNA, 21 nt, Artificial Sequence
  Description of Artificial Sequence: Synthetic oligonucleotide
acuuugccgccuaugagcauu

SEQ ID NO: 23281 - RNA, 21 nt, Artificial Sequence
  Description of Artificial Sequence: Synthetic oligonucleotide
cuuugccgccuaugagcaauu

SEQ ID NO: 23282 - RNA, 21 nt, Artificial Sequence
  Description of Artificial Sequence: Synthetic oligonucleotide
uuugccgccuaugagcagauu

SEQ ID NO: 23283 - RNA, 21 nt, Artificial Sequence
  Description of Artificial Sequence: Synthetic oligonucleotide
uugccgccuaugagcagcauu

SEQ ID NO: 23284 - RNA, 21 nt, Artificial Sequence
  Description of Artificial Sequence: Synthetic oligonucleotide
ugccgccuaugagcagccauu

SEQ ID NO: 23285 - RNA, 21 nt, Artificial Sequence
  Description of Artificial Sequence: Synthetic oligonucleotide
gccgccuaugagcagccaauu

SEQ ID NO: 23286 - RNA, 21 nt, Artificial Sequence
  Description of Artificial Sequence: Synthetic oligonucleotide
ccgccuaugagcagccacauu

SEQ ID NO: 23287 - RNA, 21 nt, Artificial Sequence
  Description of Artificial Sequence: Synthetic oligonucleotide
cgccuaugagcagccacaauu

SEQ ID NO: 23288 - RNA, 21 nt, Artificial Sequence
  Description of Artificial Sequence: Synthetic oligonucleotide
gccuaugagcagccacauauu

SEQ ID NO: 23289 - RNA, 21 nt, Artificial Sequence
  Description of Artificial Sequence: Synthetic oligonucleotide
ccuaugagcagccacauuauu

SEQ ID NO: 23290 - RNA, 21 nt, Artificial Sequence
  Description of Artificial Sequence: Synthetic oligonucleotide
cuaugagcagccacauugauu

SEQ ID NO: 23291 - RNA, 21 nt, Artificial Sequence
  Description of Artificial Sequence: Synthetic oligonucleotide
uaugagcagccacauugcauu

SEQ ID NO: 23292 - RNA, 21 nt, Artificial Sequence
  Description of Artificial Sequence: Synthetic oligonucleotide
augagcagccacauugccauu

SEQ ID NO: 23293 - RNA, 21 nt, Artificial Sequence
  Description of Artificial Sequence: Synthetic oligonucleotide
ugagcagccacauugccuauu

SEQ ID NO: 23294 - RNA, 21 nt, Artificial Sequence
  Description of Artificial Sequence: Synthetic oligonucleotide
gagcagccacauugccuuauu

SEQ ID NO: 23295 - RNA, 21 nt, Artificial Sequence
  Description of Artificial Sequence: Synthetic oligonucleotide
agcagccacauugccuuaauu

SEQ ID NO: 23296 - RNA, 21 nt, Artificial Sequence
  Description of Artificial Sequence: Synthetic oligonucleotide
gcagccacauugccuuacauu

SEQ ID NO: 23297 - RNA, 21 nt, Artificial Sequence
  Description of Artificial Sequence: Synthetic oligonucleotide
cagccacauugccuuacuauu

SEQ ID NO: 23298 - RNA, 21 nt, Artificial Sequence
  Description of Artificial Sequence: Synthetic oligonucleotide
agccacauugccuuacugauu

SEQ ID NO: 23299 - DNA, 20 bp, Artificial Sequence
  Description of Artificial Sequence: Synthetic oligonucleotide
taagttggagtctccctgat

SEQ ID NO: 23300 - DNA, 20 bp, Artificial Sequence
  Description of Artificial Sequence: Synthetic oligonucleotide
ttaagttggagtctccctga

SEQ ID NO: 23301 - DNA, 20 bp, Artificial Sequence
  Description of Artificial Sequence: Synthetic oligonucleotide
cttaagttggagtctccctg

SEQ ID NO: 23302 - DNA, 20 bp, Artificial Sequence
  Description of Artificial Sequence: Synthetic oligonucleotide
ccttaagttggagtctccct

SEQ ID NO: 23303 - DNA, 20 bp, Artificial Sequence
  Description of Artificial Sequence: Synthetic oligonucleotide
gccttaagttggagtctccc

SEQ ID NO: 23304 - DNA, 20 bp, Artificial Sequence
  Description of Artificial Sequence: Synthetic oligonucleotide
tgccttaagttggagtctcc

SEQ ID NO: 23305 - DNA, 20 bp, Artificial Sequence
  Description of Artificial Sequence: Synthetic oligonucleotide
ttgccttaagttggagtctc

SEQ ID NO: 23306 - DNA, 20 bp, Artificial Sequence
  Description of Artificial Sequence: Synthetic oligonucleotide
gttgccttaagttggagtct

SEQ ID NO: 23307 - DNA, 20 bp, Artificial Sequence
  Description of Artificial Sequence: Synthetic oligonucleotide
tgttgccttaagttggagtc

SEQ ID NO: 23308 - DNA, 20 bp, Artificial Sequence
  Description of Artificial Sequence: Synthetic oligonucleotide
ctgttgccttaagttggagt

SEQ ID NO: 23309 - DNA, 20 bp, Artificial Sequence
  Description of Artificial Sequence: Synthetic oligonucleotide
gctgttgccttaagttggag

SEQ ID NO: 23310 - DNA, 20 bp, Artificial Sequence
  Description of Artificial Sequence: Synthetic oligonucleotide
tgctgttgccttaagttgga

SEQ ID NO: 23311 - DNA, 20 bp, Artificial Sequence
  Description of Artificial Sequence: Synthetic oligonucleotide
atgctgttgccttaagttgg

SEQ ID NO: 23312 - DNA, 20 bp, Artificial Sequence
  Description of Artificial Sequence: Synthetic oligonucleotide
catgctgttgccttaagttg

SEQ ID NO: 23313 - DNA, 20 bp, Artificial Sequence
  Description of Artificial Sequence: Synthetic oligonucleotide
ccatgctgttgccttaagtt

SEQ ID NO: 23314 - DNA, 20 bp, Artificial Sequence
  Description of Artificial Sequence: Synthetic oligonucleotide
cccatgctgttgccttaagt

SEQ ID NO: 23315 - DNA, 20 bp, Artificial Sequence
  Description of Artificial Sequence: Synthetic oligonucleotide
acccatgctgttgccttaag

SEQ ID NO: 23316 - DNA, 20 bp, Artificial Sequence
  Description of Artificial Sequence: Synthetic oligonucleotide
cacccatgctgttgccttaa

SEQ ID NO: 23317 - DNA, 20 bp, Artificial Sequence
  Description of Artificial Sequence: Synthetic oligonucleotide
tcacccatgctgttgcctta

SEQ ID NO: 23318 - DNA, 20 bp, Artificial Sequence
  Description of Artificial Sequence: Synthetic oligonucleotide
ttcacccatgctgttgcctt

SEQ ID NO: 23319 - DNA, 20 bp, Artificial Sequence
  Description of Artificial Sequence: Synthetic oligonucleotide
attcacccatgctgttgcct

SEQ ID NO: 23320 - DNA, 20 bp, Artificial Sequence
  Description of Artificial Sequence: Synthetic oligonucleotide
tattcacccatgctgttgcc

SEQ ID NO: 23321 - DNA, 20 bp, Artificial Sequence
  Description of Artificial Sequence: Synthetic oligonucleotide
ttattcacccatgctgttgc

SEQ ID NO: 23322 - DNA, 20 bp, Artificial Sequence
  Description of Artificial Sequence: Synthetic oligonucleotide
cttattcacccatgctgttg

SEQ ID NO: 23323 - DNA, 20 bp, Artificial Sequence
  Description of Artificial Sequence: Synthetic oligonucleotide
ccttattcacccatgctgtt

SEQ ID NO: 23324 - DNA, 20 bp, Artificial Sequence
  Description of Artificial Sequence: Synthetic oligonucleotide
cccttattcacccatgctgt

SEQ ID NO: 23325 - DNA, 20 bp, Artificial Sequence
  Description of Artificial Sequence: Synthetic oligonucleotide
gcccttattcacccatgctg

SEQ ID NO: 23326 - DNA, 20 bp, Artificial Sequence
  Description of Artificial Sequence: Synthetic oligonucleotide
agcccttattcacccatgct

SEQ ID NO: 23327 - DNA, 20 bp, Artificial Sequence
  Description of Artificial Sequence: Synthetic oligonucleotide
aagcccttattcacccatgc

SEQ ID NO: 23328 - DNA, 20 bp, Artificial Sequence
  Description of Artificial Sequence: Synthetic oligonucleotide
gaagcccttattcacccatg

SEQ ID NO: 23329 - DNA, 20 bp, Artificial Sequence
  Description of Artificial Sequence: Synthetic oligonucleotide
ggaagcccttattcacccat

SEQ ID NO: 23330 - DNA, 20 bp, Artificial Sequence
  Description of Artificial Sequence: Synthetic oligonucleotide
aggaagcccttattcaccca

SEQ ID NO: 23331 - DNA, 20 bp, Artificial Sequence
  Description of Artificial Sequence: Synthetic oligonucleotide
caggaagcccttattcaccc

SEQ ID NO: 23332 - DNA, 20 bp, Artificial Sequence
  Description of Artificial Sequence: Synthetic oligonucleotide
acaggaagcccttattcacc

SEQ ID NO: 23333 - DNA, 20 bp, Artificial Sequence
  Description of Artificial Sequence: Synthetic oligonucleotide
cacaggaagcccttattcac

SEQ ID NO: 23334 - DNA, 20 bp, Artificial Sequence
  Description of Artificial Sequence: Synthetic oligonucleotide
ccacaggaagcccttattca

SEQ ID NO: 23335 - DNA, 20 bp, Artificial Sequence
  Description of Artificial Sequence: Synthetic oligonucleotide
tccacaggaagcccttattc

SEQ ID NO: 23336 - DNA, 20 bp, Artificial Sequence
  Description of Artificial Sequence: Synthetic oligonucleotide
gtccacaggaagcccttatt

SEQ ID NO: 23337 - DNA, 20 bp, Artificial Sequence
  Description of Artificial Sequence: Synthetic oligonucleotide
agtccacaggaagcccttat

SEQ ID NO: 23338 - DNA, 20 bp, Artificial Sequence
  Description of Artificial Sequence: Synthetic oligonucleotide
cagtccacaggaagccctta

SEQ ID NO: 23339 - DNA, 20 bp, Artificial Sequence
  Description of Artificial Sequence: Synthetic oligonucleotide
ccagtccacaggaagccctt

SEQ ID NO: 23340 - DNA, 20 bp, Artificial Sequence
  Description of Artificial Sequence: Synthetic oligonucleotide
gccagtccacaggaagccct

SEQ ID NO: 23341 - DNA, 20 bp, Artificial Sequence
  Description of Artificial Sequence: Synthetic oligonucleotide
tgccagtccacaggaagccc

SEQ ID NO: 23342 - DNA, 20 bp, Artificial Sequence
  Description of Artificial Sequence: Synthetic oligonucleotide
ttgccagtccacaggaagcc

SEQ ID NO: 23343 - DNA, 20 bp, Artificial Sequence
  Description of Artificial Sequence: Synthetic oligonucleotide
attgccagtccacaggaagc

SEQ ID NO: 23344 - DNA, 20 bp, Artificial Sequence
  Description of Artificial Sequence: Synthetic oligonucleotide
cattgccagtccacaggaag

SEQ ID NO: 23345 - DNA, 20 bp, Artificial Sequence
  Description of Artificial Sequence: Synthetic oligonucleotide
tcattgccagtccacaggaa

SEQ ID NO: 23346 - DNA, 20 bp, Artificial Sequence
  Description of Artificial Sequence: Synthetic oligonucleotide
ctcattgccagtccacagga

SEQ ID NO: 23347 - DNA, 20 bp, Artificial Sequence
  Description of Artificial Sequence: Synthetic oligonucleotide
tctcattgccagtccacagg

SEQ ID NO: 23348 - DNA, 20 bp, Artificial Sequence
  Description of Artificial Sequence: Synthetic oligonucleotide
ctctcattgccagtccacag

SEQ ID NO: 23349 - DNA, 20 bp, Artificial Sequence
  Description of Artificial Sequence: Synthetic oligonucleotide
cctctcattgccagtccaca

SEQ ID NO: 23350 - DNA, 20 bp, Artificial Sequence
  Description of Artificial Sequence: Synthetic oligonucleotide
gcctctcattgccagtccac

SEQ ID NO: 23351 - DNA, 20 bp, Artificial Sequence
  Description of Artificial Sequence: Synthetic oligonucleotide
tgcctctcattgccagtcca

SEQ ID NO: 23352 - DNA, 20 bp, Artificial Sequence
  Description of Artificial Sequence: Synthetic oligonucleotide
ttgcctctcattgccagtcc

SEQ ID NO: 23353 - DNA, 20 bp, Artificial Sequence
  Description of Artificial Sequence: Synthetic oligonucleotide
tttgcctctcattgccagtc

SEQ ID NO: 23354 - DNA, 20 bp, Artificial Sequence
  Description of Artificial Sequence: Synthetic oligonucleotide
ttttgcctctcattgccagt

SEQ ID NO: 23355 - DNA, 20 bp, Artificial Sequence
  Description of Artificial Sequence: Synthetic oligonucleotide
gttttgcctctcattgccag

SEQ ID NO: 23356 - DNA, 20 bp, Artificial Sequence
  Description of Artificial Sequence: Synthetic oligonucleotide
ggttttgcctctcattgcca

SEQ ID NO: 23357 - DNA, 20 bp, Artificial Sequence
  Description of Artificial Sequence: Synthetic oligonucleotide
aggttttgcctctcattgcc

SEQ ID NO: 23358 - DNA, 20 bp, Artificial Sequence
  Description of Artificial Sequence: Synthetic oligonucleotide
caggttttgcctctcattgc

SEQ ID NO: 23359 - DNA, 20 bp, Artificial Sequence
  Description of Artificial Sequence: Synthetic oligonucleotide
ccaggttttgcctctcattg

SEQ ID NO: 23360 - DNA, 20 bp, Artificial Sequence
  Description of Artificial Sequence: Synthetic oligonucleotide
accaggttttgcctctcatt

SEQ ID NO: 23361 - DNA, 20 bp, Artificial Sequence
  Description of Artificial Sequence: Synthetic oligonucleotide
caccaggttttgcctctcat

SEQ ID NO: 23362 - DNA, 20 bp, Artificial Sequence
  Description of Artificial Sequence: Synthetic oligonucleotide
gcaccaggttttgcctctca

SEQ ID NO: 23363 - DNA, 20 bp, Artificial Sequence
  Description of Artificial Sequence: Synthetic oligonucleotide
agcaccaggttttgcctctc

SEQ ID NO: 23364 - DNA, 20 bp, Artificial Sequence
  Description of Artificial Sequence: Synthetic oligonucleotide
aagcaccaggttttgcctct

SEQ ID NO: 23365 - DNA, 20 bp, Artificial Sequence
  Description of Artificial Sequence: Synthetic oligonucleotide
caagcaccaggttttgcctc

SEQ ID NO: 23366 - DNA, 20 bp, Artificial Sequence
  Description of Artificial Sequence: Synthetic oligonucleotide
tcaagcaccaggttttgcct

SEQ ID NO: 23367 - DNA, 20 bp, Artificial Sequence
  Description of Artificial Sequence: Synthetic oligonucleotide
ctcaagcaccaggttttgcc

SEQ ID NO: 23368 - DNA, 20 bp, Artificial Sequence
  Description of Artificial Sequence: Synthetic oligonucleotide
gctcaagcaccaggttttgc

SEQ ID NO: 23369 - DNA, 20 bp, Artificial Sequence
  Description of Artificial Sequence: Synthetic oligonucleotide
tgctcaagcaccaggttttg

SEQ ID NO: 23370 - DNA, 20 bp, Artificial Sequence
  Description of Artificial Sequence: Synthetic oligonucleotide
gtgctcaagcaccaggtttt

SEQ ID NO: 23371 - DNA, 20 bp, Artificial Sequence
  Description of Artificial Sequence: Synthetic oligonucleotide
agtgctcaagcaccaggttt

SEQ ID NO: 23372 - DNA, 20 bp, Artificial Sequence
  Description of Artificial Sequence: Synthetic oligonucleotide
cagtgctcaagcaccaggtt

SEQ ID NO: 23373 - DNA, 20 bp, Artificial Sequence
  Description of Artificial Sequence: Synthetic oligonucleotide
ccagtgctcaagcaccaggt

SEQ ID NO: 23374 - DNA, 20 bp, Artificial Sequence
  Description of Artificial Sequence: Synthetic oligonucleotide
gccagtgctcaagcaccagg

SEQ ID NO: 23375 - DNA, 20 bp, Artificial Sequence
  Description of Artificial Sequence: Synthetic oligonucleotide
ggccagtgctcaagcaccag

SEQ ID NO: 23376 - DNA, 20 bp, Artificial Sequence
  Description of Artificial Sequence: Synthetic oligonucleotide
gggccagtgctcaagcacca

SEQ ID NO: 23377 - DNA, 20 bp, Artificial Sequence
  Description of Artificial Sequence: Synthetic oligonucleotide
ggggccagtgctcaagcacc

SEQ ID NO: 23378 - DNA, 20 bp, Artificial Sequence
  Description of Artificial Sequence: Synthetic oligonucleotide
aggggccagtgctcaagcac

SEQ ID NO: 23379 - DNA, 20 bp, Artificial Sequence
  Description of Artificial Sequence: Synthetic oligonucleotide
taggggccagtgctcaagca

SEQ ID NO: 23380 - DNA, 20 bp, Artificial Sequence
  Description of Artificial Sequence: Synthetic oligonucleotide
ttaggggccagtgctcaagc

SEQ ID NO: 23381 - DNA, 20 bp, Artificial Sequence
  Description of Artificial Sequence: Synthetic oligonucleotide
cttaggggccagtgctcaag

SEQ ID NO: 23382 - DNA, 20 bp, Artificial Sequence
  Description of Artificial Sequence: Synthetic oligonucleotide
ccttaggggccagtgctcaa

SEQ ID NO: 23383 - DNA, 20 bp, Artificial Sequence
  Description of Artificial Sequence: Synthetic oligonucleotide
gccttaggggccagtgctca

SEQ ID NO: 23384 - DNA, 20 bp, Artificial Sequence
  Description of Artificial Sequence: Synthetic oligonucleotide
tgccttaggggccagtgctc

SEQ ID NO: 23385 - DNA, 20 bp, Artificial Sequence
  Description of Artificial Sequence: Synthetic oligonucleotide
ctgccttaggggccagtgct

SEQ ID NO: 23386 - DNA, 20 bp, Artificial Sequence
  Description of Artificial Sequence: Synthetic oligonucleotide
cctgccttaggggccagtgc

SEQ ID NO: 23387 - DNA, 20 bp, Artificial Sequence
  Description of Artificial Sequence: Synthetic oligonucleotide
gcctgccttaggggccagtg

SEQ ID NO: 23388 - DNA, 20 bp, Artificial Sequence
  Description of Artificial Sequence: Synthetic oligonucleotide
ggcctgccttaggggccagt

SEQ ID NO: 23389 - DNA, 20 bp, Artificial Sequence
  Description of Artificial Sequence: Synthetic oligonucleotide
aggcctgccttaggggccag

SEQ ID NO: 23390 - DNA, 20 bp, Artificial Sequence
  Description of Artificial Sequence: Synthetic oligonucleotide
aaggcctgccttaggggcca

SEQ ID NO: 23391 - DNA, 20 bp, Artificial Sequence
  Description of Artificial Sequence: Synthetic oligonucleotide
taaggcctgccttaggggcc

SEQ ID NO: 23392 - DNA, 20 bp, Artificial Sequence
  Description of Artificial Sequence: Synthetic oligonucleotide
gtaaggcctgccttaggggc

SEQ ID NO: 23393 - DNA, 20 bp, Artificial Sequence
  Description of Artificial Sequence: Synthetic oligonucleotide
tgtaaggcctgccttagggg

SEQ ID NO: 23394 - DNA, 20 bp, Artificial Sequence
  Description of Artificial Sequence: Synthetic oligonucleotide
ctgtaaggcctgccttaggg

SEQ ID NO: 23395 - DNA, 20 bp, Artificial Sequence
  Description of Artificial Sequence: Synthetic oligonucleotide
tctgtaaggcctgccttagg

SEQ ID NO: 23396 - DNA, 20 bp, Artificial Sequence
  Description of Artificial Sequence: Synthetic oligonucleotide
atctgtaaggcctgccttag

SEQ ID NO: 23397 - DNA, 20 bp, Artificial Sequence
  Description of Artificial Sequence: Synthetic oligonucleotide
gatctgtaaggcctgcctta

SEQ ID NO: 23398 - DNA, 20 bp, Artificial Sequence
  Description of Artificial Sequence: Synthetic oligonucleotide
agatctgtaaggcctgcctt

SEQ ID NO: 23399 - DNA, 20 bp, Artificial Sequence
  Description of Artificial Sequence: Synthetic oligonucleotide
gagatctgtaaggcctgcct

SEQ ID NO: 23400 - DNA, 20 bp, Artificial Sequence
  Description of Artificial Sequence: Synthetic oligonucleotide
agagatctgtaaggcctgcc

SEQ ID NO: 23401 - DNA, 20 bp, Artificial Sequence
  Description of Artificial Sequence: Synthetic oligonucleotide
aagagatctgtaaggcctgc

SEQ ID NO: 23402 - DNA, 20 bp, Artificial Sequence
  Description of Artificial Sequence: Synthetic oligonucleotide
taagagatctgtaaggcctg

SEQ ID NO: 23403 - DNA, 20 bp, Artificial Sequence
  Description of Artificial Sequence: Synthetic oligonucleotide
gtaagagatctgtaaggcct

SEQ ID NO: 23404 - DNA, 20 bp, Artificial Sequence
  Description of Artificial Sequence: Synthetic oligonucleotide
tgtaagagatctgtaaggcc

SEQ ID NO: 23405 - DNA, 20 bp, Artificial Sequence
  Description of Artificial Sequence: Synthetic oligonucleotide
gtgtaagagatctgtaaggc

SEQ ID NO: 23406 - DNA, 20 bp, Artificial Sequence
  Description of Artificial Sequence: Synthetic oligonucleotide
agtgtaagagatctgtaagg

SEQ ID NO: 23407 - DNA, 20 bp, Artificial Sequence
  Description of Artificial Sequence: Synthetic oligonucleotide
gagtgtaagagatctgtaag

SEQ ID NO: 23408 - DNA, 20 bp, Artificial Sequence
  Description of Artificial Sequence: Synthetic oligonucleotide
cgagtgtaagagatctgtaa

SEQ ID NO: 23409 - DNA, 20 bp, Artificial Sequence
  Description of Artificial Sequence: Synthetic oligonucleotide
acgagtgtaagagatctgta

SEQ ID NO: 23410 - DNA, 20 bp, Artificial Sequence
  Description of Artificial Sequence: Synthetic oligonucleotide
cacgagtgtaagagatctgt

SEQ ID NO: 23411 - DNA, 20 bp, Artificial Sequence
  Description of Artificial Sequence: Synthetic oligonucleotide
ccacgagtgtaagagatctg

SEQ ID NO: 23412 - DNA, 20 bp, Artificial Sequence
  Description of Artificial Sequence: Synthetic oligonucleotide
accacgagtgtaagagatct

SEQ ID NO: 23413 - DNA, 20 bp, Artificial Sequence
  Description of Artificial Sequence: Synthetic oligonucleotide
caccacgagtgtaagagatc

SEQ ID NO: 23414 - DNA, 20 bp, Artificial Sequence
  Description of Artificial Sequence: Synthetic oligonucleotide
ccaccacgagtgtaagagat

SEQ ID NO: 23415 - DNA, 20 bp, Artificial Sequence
  Description of Artificial Sequence: Synthetic oligonucleotide
cccaccacgagtgtaagaga

SEQ ID NO: 23416 - DNA, 20 bp, Artificial Sequence
  Description of Artificial Sequence: Synthetic oligonucleotide
tcccaccacgagtgtaagag

SEQ ID NO: 23417 - DNA, 20 bp, Artificial Sequence
  Description of Artificial Sequence: Synthetic oligonucleotide
ttcccaccacgagtgtaaga

SEQ ID NO: 23418 - DNA, 20 bp, Artificial Sequence
  Description of Artificial Sequence: Synthetic oligonucleotide
cttcccaccacgagtgtaag

SEQ ID NO: 23419 - DNA, 20 bp, Artificial Sequence
  Description of Artificial Sequence: Synthetic oligonucleotide
tcttcccaccacgagtgtaa

SEQ ID NO: 23420 - DNA, 20 bp, Artificial Sequence
  Description of Artificial Sequence: Synthetic oligonucleotide
ctcttcccaccacgagtgta

SEQ ID NO: 23421 - DNA, 20 bp, Artificial Sequence
  Description of Artificial Sequence: Synthetic oligonucleotide
actcttcccaccacgagtgt

SEQ ID NO: 23422 - DNA, 20 bp, Artificial Sequence
  Description of Artificial Sequence: Synthetic oligonucleotide
aactcttcccaccacgagtg

SEQ ID NO: 23423 - DNA, 20 bp, Artificial Sequence
  Description of Artificial Sequence: Synthetic oligonucleotide
aaactcttcccaccacgagt

SEQ ID NO: 23424 - DNA, 20 bp, Artificial Sequence
  Description of Artificial Sequence: Synthetic oligonucleotide
taaactcttcccaccacgag

SEQ ID NO: 23425 - DNA, 20 bp, Artificial Sequence
  Description of Artificial Sequence: Synthetic oligonucleotide
ctaaactcttcccaccacga

SEQ ID NO: 23426 - DNA, 20 bp, Artificial Sequence
  Description of Artificial Sequence: Synthetic oligonucleotide
actaaactcttcccaccacg

SEQ ID NO: 23427 - DNA, 20 bp, Artificial Sequence
  Description of Artificial Sequence: Synthetic oligonucleotide
cactaaactcttcccaccac

SEQ ID NO: 23428 - DNA, 20 bp, Artificial Sequence
  Description of Artificial Sequence: Synthetic oligonucleotide
acactaaactcttcccacca

SEQ ID NO: 23429 - DNA, 20 bp, Artificial Sequence
  Description of Artificial Sequence: Synthetic oligonucleotide
cacactaaactcttcccacc

SEQ ID NO: 23430 - DNA, 20 bp, Artificial Sequence
  Description of Artificial Sequence: Synthetic oligonucleotide
tcacactaaactcttcccac

SEQ ID NO: 23431 - DNA, 20 bp, Artificial Sequence
  Description of Artificial Sequence: Synthetic oligonucleotide
ttcacactaaactcttccca

SEQ ID NO: 23432 - DNA, 20 bp, Artificial Sequence
  Description of Artificial Sequence: Synthetic oligonucleotide
tttcacactaaactcttccc

SEQ ID NO: 23433 - DNA, 20 bp, Artificial Sequence
  Description of Artificial Sequence: Synthetic oligonucleotide
gtttcacactaaactcttcc

SEQ ID NO: 23434 - DNA, 20 bp, Artificial Sequence
  Description of Artificial Sequence: Synthetic oligonucleotide
agtttcacactaaactcttc

SEQ ID NO: 23435 - DNA, 20 bp, Artificial Sequence
  Description of Artificial Sequence: Synthetic oligonucleotide
cagtttcacactaaactctt

SEQ ID NO: 23436 - DNA, 20 bp, Artificial Sequence
  Description of Artificial Sequence: Synthetic oligonucleotide
ccagtttcacactaaactct

SEQ ID NO: 23437 - DNA, 20 bp, Artificial Sequence
  Description of Artificial Sequence: Synthetic oligonucleotide
cccagtttcacactaaactc

SEQ ID NO: 23438 - DNA, 20 bp, Artificial Sequence
  Description of Artificial Sequence: Synthetic oligonucleotide
ccccagtttcacactaaact

SEQ ID NO: 23439 - DNA, 20 bp, Artificial Sequence
  Description of Artificial Sequence: Synthetic oligonucleotide
accccagtttcacactaaac

SEQ ID NO: 23440 - DNA, 20 bp, Artificial Sequence
  Description of Artificial Sequence: Synthetic oligonucleotide
caccccagtttcacactaaa

SEQ ID NO: 23441 - DNA, 20 bp, Artificial Sequence
  Description of Artificial Sequence: Synthetic oligonucleotide
ccaccccagtttcacactaa

SEQ ID NO: 23442 - DNA, 20 bp, Artificial Sequence
  Description of Artificial Sequence: Synthetic oligonucleotide
tccaccccagtttcacacta

SEQ ID NO: 23443 - DNA, 20 bp, Artificial Sequence
  Description of Artificial Sequence: Synthetic oligonucleotide
ttccaccccagtttcacact

SEQ ID NO: 23444 - DNA, 20 bp, Artificial Sequence
  Description of Artificial Sequence: Synthetic oligonucleotide
attccaccccagtttcacac

SEQ ID NO: 23445 - DNA, 20 bp, Artificial Sequence
  Description of Artificial Sequence: Synthetic oligonucleotide
aattccaccccagtttcaca

SEQ ID NO: 23446 - DNA, 20 bp, Artificial Sequence
  Description of Artificial Sequence: Synthetic oligonucleotide
caattccaccccagtttcac

SEQ ID NO: 23447 - DNA, 20 bp, Artificial Sequence
  Description of Artificial Sequence: Synthetic oligonucleotide
ccaattccaccccagtttca

SEQ ID NO: 23448 - DNA, 20 bp, Artificial Sequence
  Description of Artificial Sequence: Synthetic oligonucleotide
cccaattccaccccagtttc

SEQ ID NO: 23449 - DNA, 20 bp, Artificial Sequence
  Description of Artificial Sequence: Synthetic oligonucleotide
acccaattccaccccagttt

SEQ ID NO: 23450 - DNA, 20 bp, Artificial Sequence
  Description of Artificial Sequence: Synthetic oligonucleotide
cacccaattccaccccagtt

SEQ ID NO: 23451 - DNA, 20 bp, Artificial Sequence
  Description of Artificial Sequence: Synthetic oligonucleotide
acacccaattccaccccagt

SEQ ID NO: 23452 - DNA, 20 bp, Artificial Sequence
  Description of Artificial Sequence: Synthetic oligonucleotide
gacacccaattccaccccag

SEQ ID NO: 23453 - DNA, 20 bp, Artificial Sequence
  Description of Artificial Sequence: Synthetic oligonucleotide
ggacacccaattccacccca

SEQ ID NO: 23454 - DNA, 20 bp, Artificial Sequence
  Description of Artificial Sequence: Synthetic oligonucleotide
tggacacccaattccacccc

SEQ ID NO: 23455 - DNA, 20 bp, Artificial Sequence
  Description of Artificial Sequence: Synthetic oligonucleotide
gtggacacccaattccaccc

SEQ ID NO: 23456 - DNA, 20 bp, Artificial Sequence
  Description of Artificial Sequence: Synthetic oligonucleotide
cgtggacacccaattccacc

SEQ ID NO: 23457 - DNA, 20 bp, Artificial Sequence
  Description of Artificial Sequence: Synthetic oligonucleotide
acgtggacacccaattccac

SEQ ID NO: 23458 - DNA, 20 bp, Artificial Sequence
  Description of Artificial Sequence: Synthetic oligonucleotide
tacgtggacacccaattcca

SEQ ID NO: 23459 - DNA, 20 bp, Artificial Sequence
  Description of Artificial Sequence: Synthetic oligonucleotide
atacgtggacacccaattcc

SEQ ID NO: 23460 - DNA, 20 bp, Artificial Sequence
  Description of Artificial Sequence: Synthetic oligonucleotide
catacgtggacacccaattc

SEQ ID NO: 23461 - DNA, 20 bp, Artificial Sequence
  Description of Artificial Sequence: Synthetic oligonucleotide
acatacgtggacacccaatt

SEQ ID NO: 23462 - DNA, 20 bp, Artificial Sequence
  Description of Artificial Sequence: Synthetic oligonucleotide
aacatacgtggacacccaat

SEQ ID NO: 23463 - DNA, 20 bp, Artificial Sequence
  Description of Artificial Sequence: Synthetic oligonucleotide
gaacatacgtggacacccaa

SEQ ID NO: 23464 - DNA, 20 bp, Artificial Sequence
  Description of Artificial Sequence: Synthetic oligonucleotide
ggaacatacgtggacaccca

SEQ ID NO: 23465 - DNA, 20 bp, Artificial Sequence
  Description of Artificial Sequence: Synthetic oligonucleotide
gggaacatacgtggacaccc

SEQ ID NO: 23466 - DNA, 20 bp, Artificial Sequence
  Description of Artificial Sequence: Synthetic oligonucleotide
agggaacatacgtggacacc

SEQ ID NO: 23467 - DNA, 20 bp, Artificial Sequence
  Description of Artificial Sequence: Synthetic oligonucleotide
aagggaacatacgtggacac

SEQ ID NO: 23468 - DNA, 20 bp, Artificial Sequence
  Description of Artificial Sequence: Synthetic oligonucleotide
aaagggaacatacgtggaca

SEQ ID NO: 23469 - DNA, 20 bp, Artificial Sequence
  Description of Artificial Sequence: Synthetic oligonucleotide
aaaagggaacatacgtggac

SEQ ID NO: 23470 - DNA, 20 bp, Artificial Sequence
  Description of Artificial Sequence: Synthetic oligonucleotide
caaaagggaacatacgtgga

SEQ ID NO: 23471 - DNA, 20 bp, Artificial Sequence
  Description of Artificial Sequence: Synthetic oligonucleotide
gcaaaagggaacatacgtgg

SEQ ID NO: 23472 - DNA, 20 bp, Artificial Sequence
  Description of Artificial Sequence: Synthetic oligonucleotide
ggcaaaagggaacatacgtg

SEQ ID NO: 23473 - DNA, 20 bp, Artificial Sequence
  Description of Artificial Sequence: Synthetic oligonucleotide
aggcaaaagggaacatacgt

SEQ ID NO: 23474 - DNA, 20 bp, Artificial Sequence
  Description of Artificial Sequence: Synthetic oligonucleotide
aaggcaaaagggaacatacg

SEQ ID NO: 23475 - DNA, 20 bp, Artificial Sequence
  Description of Artificial Sequence: Synthetic oligonucleotide
taaggcaaaagggaacatac

SEQ ID NO: 23476 - DNA, 20 bp, Artificial Sequence
  Description of Artificial Sequence: Synthetic oligonucleotide
gtaaggcaaaagggaacata

SEQ ID NO: 23477 - DNA, 20 bp, Artificial Sequence
  Description of Artificial Sequence: Synthetic oligonucleotide
agtaaggcaaaagggaacat

SEQ ID NO: 23478 - DNA, 20 bp, Artificial Sequence
  Description of Artificial Sequence: Synthetic oligonucleotide
tagtaaggcaaaagggaaca

SEQ ID NO: 23479 - DNA, 20 bp, Artificial Sequence
  Description of Artificial Sequence: Synthetic oligonucleotide
atagtaaggcaaaagggaac

SEQ ID NO: 23480 - DNA, 20 bp, Artificial Sequence
  Description of Artificial Sequence: Synthetic oligonucleotide
tatagtaaggcaaaagggaa

SEQ ID NO: 23481 - DNA, 20 bp, Artificial Sequence
  Description of Artificial Sequence: Synthetic oligonucleotide
atatagtaaggcaaaaggga

SEQ ID NO: 23482 - DNA, 20 bp, Artificial Sequence
  Description of Artificial Sequence: Synthetic oligonucleotide
catatagtaaggcaaaaggg

SEQ ID NO: 23483 - DNA, 20 bp, Artificial Sequence
  Description of Artificial Sequence: Synthetic oligonucleotide
acatatagtaaggcaaaagg

SEQ ID NO: 23484 - DNA, 20 bp, Artificial Sequence
  Description of Artificial Sequence: Synthetic oligonucleotide
aacatatagtaaggcaaaag

SEQ ID NO: 23485 - DNA, 20 bp, Artificial Sequence
  Description of Artificial Sequence: Synthetic oligonucleotide
gaacatatagtaaggcaaaa

SEQ ID NO: 23486 - DNA, 20 bp, Artificial Sequence
  Description of Artificial Sequence: Synthetic oligonucleotide
agaacatatagtaaggcaaa

SEQ ID NO: 23487 - DNA, 20 bp, Artificial Sequence
  Description of Artificial Sequence: Synthetic oligonucleotide
cagaacatatagtaaggcaa

SEQ ID NO: 23488 - DNA, 20 bp, Artificial Sequence
  Description of Artificial Sequence: Synthetic oligonucleotide
acagaacatatagtaaggca

SEQ ID NO: 23489 - DNA, 20 bp, Artificial Sequence
  Description of Artificial Sequence: Synthetic oligonucleotide
gacagaacatatagtaaggc

SEQ ID NO: 23490 - DNA, 20 bp, Artificial Sequence
  Description of Artificial Sequence: Synthetic oligonucleotide
tgacagaacatatagtaagg

SEQ ID NO: 23491 - DNA, 20 bp, Artificial Sequence
  Description of Artificial Sequence: Synthetic oligonucleotide
ctgacagaacatatagtaag

SEQ ID NO: 23492 - DNA, 20 bp, Artificial Sequence
  Description of Artificial Sequence: Synthetic oligonucleotide
actgacagaacatatagtaa

SEQ ID NO: 23493 - DNA, 20 bp, Artificial Sequence
  Description of Artificial Sequence: Synthetic oligonucleotide
aactgacagaacatatagta

SEQ ID NO: 23494 - DNA, 20 bp, Artificial Sequence
  Description of Artificial Sequence: Synthetic oligonucleotide
aaactgacagaacatatagt

SEQ ID NO: 23495 - DNA, 20 bp, Artificial Sequence
  Description of Artificial Sequence: Synthetic oligonucleotide
gaaactgacagaacatatag

SEQ ID NO: 23496 - DNA, 20 bp, Artificial Sequence
  Description of Artificial Sequence: Synthetic oligonucleotide
agaaactgacagaacatata

SEQ ID NO: 23497 - DNA, 20 bp, Artificial Sequence
  Description of Artificial Sequence: Synthetic oligonucleotide
aagaaactgacagaacatat

SEQ ID NO: 23498 - DNA, 20 bp, Artificial Sequence
  Description of Artificial Sequence: Synthetic oligonucleotide
aaagaaactgacagaacata

SEQ ID NO: 23499 - DNA, 20 bp, Artificial Sequence
  Description of Artificial Sequence: Synthetic oligonucleotide
gaaagaaactgacagaacat

SEQ ID NO: 23500 - DNA, 20 bp, Artificial Sequence
  Description of Artificial Sequence: Synthetic oligonucleotide
tgaaagaaactgacagaaca

SEQ ID NO: 23501 - DNA, 20 bp, Artificial Sequence
  Description of Artificial Sequence: Synthetic oligonucleotide
ctgaaagaaactgacagaac

SEQ ID NO: 23502 - DNA, 20 bp, Artificial Sequence
  Description of Artificial Sequence: Synthetic oligonucleotide
cctgaaagaaactgacagaa

SEQ ID NO: 23503 - DNA, 20 bp, Artificial Sequence
  Description of Artificial Sequence: Synthetic oligonucleotide
tcctgaaagaaactgacaga

SEQ ID NO: 23504 - DNA, 20 bp, Artificial Sequence
  Description of Artificial Sequence: Synthetic oligonucleotide
ttcctgaaagaaactgacag

SEQ ID NO: 23505 - DNA, 20 bp, Artificial Sequence
  Description of Artificial Sequence: Synthetic oligonucleotide
tttcctgaaagaaactgaca

SEQ ID NO: 23506 - DNA, 20 bp, Artificial Sequence
  Description of Artificial Sequence: Synthetic oligonucleotide
ttttcctgaaagaaactgac

SEQ ID NO: 23507 - DNA, 20 bp, Artificial Sequence
  Description of Artificial Sequence: Synthetic oligonucleotide
attttcctgaaagaaactga

SEQ ID NO: 23508 - DNA, 20 bp, Artificial Sequence
  Description of Artificial Sequence: Synthetic oligonucleotide
gattttcctgaaagaaactg

SEQ ID NO: 23509 - DNA, 20 bp, Artificial Sequence
  Description of Artificial Sequence: Synthetic oligonucleotide
agattttcctgaaagaaact

SEQ ID NO: 23510 - DNA, 20 bp, Artificial Sequence
  Description of Artificial Sequence: Synthetic oligonucleotide
aagattttcctgaaagaaac

SEQ ID NO: 23511 - DNA, 20 bp, Artificial Sequence
  Description of Artificial Sequence: Synthetic oligonucleotide
gaagattttcctgaaagaaa

SEQ ID NO: 23512 - DNA, 20 bp, Artificial Sequence
  Description of Artificial Sequence: Synthetic oligonucleotide
tgaagattttcctgaaagaa

SEQ ID NO: 23513 - DNA, 20 bp, Artificial Sequence
  Description of Artificial Sequence: Synthetic oligonucleotide
atgaagattttcctgaaaga

SEQ ID NO: 23514 - DNA, 20 bp, Artificial Sequence
  Description of Artificial Sequence: Synthetic oligonucleotide
gatgaagattttcctgaaag

SEQ ID NO: 23515 - DNA, 20 bp, Artificial Sequence
  Description of Artificial Sequence: Synthetic oligonucleotide
agatgaagattttcctgaaa

SEQ ID NO: 23516 - DNA, 20 bp, Artificial Sequence
  Description of Artificial Sequence: Synthetic oligonucleotide
aagatgaagattttcctgaa

SEQ ID NO: 23517 - DNA, 20 bp, Artificial Sequence
  Description of Artificial Sequence: Synthetic oligonucleotide
taagatgaagattttcctga

SEQ ID NO: 23518 - DNA, 20 bp, Artificial Sequence
  Description of Artificial Sequence: Synthetic oligonucleotide
gtaagatgaagattttcctg

SEQ ID NO: 23519 - DNA, 20 bp, Artificial Sequence
  Description of Artificial Sequence: Synthetic oligonucleotide
tgtaagatgaagattttcct

SEQ ID NO: 23520 - DNA, 20 bp, Artificial Sequence
  Description of Artificial Sequence: Synthetic oligonucleotide
ttgtaagatgaagattttcc

SEQ ID NO: 23521 - DNA, 20 bp, Artificial Sequence
  Description of Artificial Sequence: Synthetic oligonucleotide
gttgtaagatgaagattttc

SEQ ID NO: 23522 - DNA, 20 bp, Artificial Sequence
  Description of Artificial Sequence: Synthetic oligonucleotide
agttgtaagatgaagatttt

SEQ ID NO: 23523 - DNA, 20 bp, Artificial Sequence
  Description of Artificial Sequence: Synthetic oligonucleotide
aagttgtaagatgaagattt

SEQ ID NO: 23524 - DNA, 20 bp, Artificial Sequence
  Description of Artificial Sequence: Synthetic oligonucleotide
caagttgtaagatgaagatt

SEQ ID NO: 23525 - DNA, 20 bp, Artificial Sequence
  Description of Artificial Sequence: Synthetic oligonucleotide
acaagttgtaagatgaagat

SEQ ID NO: 23526 - DNA, 20 bp, Artificial Sequence
  Description of Artificial Sequence: Synthetic oligonucleotide
tacaagttgtaagatgaaga

SEQ ID NO: 23527 - DNA, 20 bp, Artificial Sequence
  Description of Artificial Sequence: Synthetic oligonucleotide
ctacaagttgtaagatgaag

SEQ ID NO: 23528 - DNA, 20 bp, Artificial Sequence
  Description of Artificial Sequence: Synthetic oligonucleotide
cctacaagttgtaagatgaa

SEQ ID NO: 23529 - DNA, 20 bp, Artificial Sequence
  Description of Artificial Sequence: Synthetic oligonucleotide
ccctacaagttgtaagatga

SEQ ID NO: 23530 - DNA, 20 bp, Artificial Sequence
  Description of Artificial Sequence: Synthetic oligonucleotide
gccctacaagttgtaagatg

SEQ ID NO: 23531 - DNA, 20 bp, Artificial Sequence
  Description of Artificial Sequence: Synthetic oligonucleotide
agccctacaagttgtaagat

SEQ ID NO: 23532 - DNA, 20 bp, Artificial Sequence
  Description of Artificial Sequence: Synthetic oligonucleotide
cagccctacaagttgtaaga

SEQ ID NO: 23533 - DNA, 20 bp, Artificial Sequence
  Description of Artificial Sequence: Synthetic oligonucleotide
ccagccctacaagttgtaag

SEQ ID NO: 23534 - DNA, 20 bp, Artificial Sequence
  Description of Artificial Sequence: Synthetic oligonucleotide
accagccctacaagttgtaa

SEQ ID NO: 23535 - DNA, 20 bp, Artificial Sequence
  Description of Artificial Sequence: Synthetic oligonucleotide
caccagccctacaagttgta

SEQ ID NO: 23536 - DNA, 20 bp, Artificial Sequence
  Description of Artificial Sequence: Synthetic oligonucleotide
acaccagccctacaagttgt

SEQ ID NO: 23537 - DNA, 20 bp, Artificial Sequence
  Description of Artificial Sequence: Synthetic oligonucleotide
aacaccagccctacaagttg

SEQ ID NO: 23538 - DNA, 20 bp, Artificial Sequence
  Description of Artificial Sequence: Synthetic oligonucleotide
taacaccagccctacaagtt

SEQ ID NO: 23539 - DNA, 20 bp, Artificial Sequence
  Description of Artificial Sequence: Synthetic oligonucleotide
ttaacaccagccctacaagt

SEQ ID NO: 23540 - DNA, 20 bp, Artificial Sequence
  Description of Artificial Sequence: Synthetic oligonucleotide
gttaacaccagccctacaag

SEQ ID NO: 23541 - DNA, 20 bp, Artificial Sequence
  Description of Artificial Sequence: Synthetic oligonucleotide
agttaacaccagccctacaa

SEQ ID NO: 23542 - DNA, 20 bp, Artificial Sequence
  Description of Artificial Sequence: Synthetic oligonucleotide
aagttaacaccagccctaca

SEQ ID NO: 23543 - DNA, 20 bp, Artificial Sequence
  Description of Artificial Sequence: Synthetic oligonucleotide
taagttaacaccagccctac

SEQ ID NO: 23544 - DNA, 20 bp, Artificial Sequence
  Description of Artificial Sequence: Synthetic oligonucleotide
gtaagttaacaccagcccta

SEQ ID NO: 23545 - DNA, 20 bp, Artificial Sequence
  Description of Artificial Sequence: Synthetic oligonucleotide
cgtaagttaacaccagccct

SEQ ID NO: 23546 - DNA, 20 bp, Artificial Sequence
  Description of Artificial Sequence: Synthetic oligonucleotide
tcgtaagttaacaccagccc

SEQ ID NO: 23547 - DNA, 20 bp, Artificial Sequence
  Description of Artificial Sequence: Synthetic oligonucleotide
gtcgtaagttaacaccagcc

SEQ ID NO: 23548 - DNA, 20 bp, Artificial Sequence
  Description of Artificial Sequence: Synthetic oligonucleotide
agtcgtaagttaacaccagc

SEQ ID NO: 23549 - DNA, 20 bp, Artificial Sequence
  Description of Artificial Sequence: Synthetic oligonucleotide
aagtcgtaagttaacaccag

SEQ ID NO: 23550 - DNA, 20 bp, Artificial Sequence
  Description of Artificial Sequence: Synthetic oligonucleotide
gaagtcgtaagttaacacca

SEQ ID NO: 23551 - DNA, 20 bp, Artificial Sequence
  Description of Artificial Sequence: Synthetic oligonucleotide
tgaagtcgtaagttaacacc

SEQ ID NO: 23552 - DNA, 20 bp, Artificial Sequence
  Description of Artificial Sequence: Synthetic oligonucleotide
gtgaagtcgtaagttaacac

SEQ ID NO: 23553 - DNA, 20 bp, Artificial Sequence
  Description of Artificial Sequence: Synthetic oligonucleotide
agtgaagtcgtaagttaaca

SEQ ID NO: 23554 - DNA, 20 bp, Artificial Sequence
  Description of Artificial Sequence: Synthetic oligonucleotide
tagtgaagtcgtaagttaac

SEQ ID NO: 23555 - DNA, 20 bp, Artificial Sequence
  Description of Artificial Sequence: Synthetic oligonucleotide
ttagtgaagtcgtaagttaa

SEQ ID NO: 23556 - DNA, 20 bp, Artificial Sequence
  Description of Artificial Sequence: Synthetic oligonucleotide
gttagtgaagtcgtaagtta

SEQ ID NO: 23557 - DNA, 20 bp, Artificial Sequence
  Description of Artificial Sequence: Synthetic oligonucleotide
agttagtgaagtcgtaagtt

SEQ ID NO: 23558 - DNA, 20 bp, Artificial Sequence
  Description of Artificial Sequence: Synthetic oligonucleotide
cagttagtgaagtcgtaagt

SEQ ID NO: 23559 - DNA, 20 bp, Artificial Sequence
  Description of Artificial Sequence: Synthetic oligonucleotide
acagttagtgaagtcgtaag

SEQ ID NO: 23560 - DNA, 20 bp, Artificial Sequence
  Description of Artificial Sequence: Synthetic oligonucleotide
cacagttagtgaagtcgtaa

SEQ ID NO: 23561 - DNA, 20 bp, Artificial Sequence
  Description of Artificial Sequence: Synthetic oligonucleotide
tcacagttagtgaagtcgta

SEQ ID NO: 23562 - DNA, 20 bp, Artificial Sequence
  Description of Artificial Sequence: Synthetic oligonucleotide
gtcacagttagtgaagtcgt

SEQ ID NO: 23563 - DNA, 20 bp, Artificial Sequence
  Description of Artificial Sequence: Synthetic oligonucleotide
agtcacagttagtgaagtcg

SEQ ID NO: 23564 - DNA, 20 bp, Artificial Sequence
  Description of Artificial Sequence: Synthetic oligonucleotide
aagtcacagttagtgaagtc

SEQ ID NO: 23565 - DNA, 20 bp, Artificial Sequence
  Description of Artificial Sequence: Synthetic oligonucleotide
aaagtcacagttagtgaagt

SEQ ID NO: 23566 - DNA, 20 bp, Artificial Sequence
  Description of Artificial Sequence: Synthetic oligonucleotide
caaagtcacagttagtgaag

SEQ ID NO: 23567 - DNA, 20 bp, Artificial Sequence
  Description of Artificial Sequence: Synthetic oligonucleotide
tcaaagtcacagttagtgaa

SEQ ID NO: 23568 - DNA, 20 bp, Artificial Sequence
  Description of Artificial Sequence: Synthetic oligonucleotide
ctcaaagtcacagttagtga

SEQ ID NO: 23569 - DNA, 20 bp, Artificial Sequence
  Description of Artificial Sequence: Synthetic oligonucleotide
tctcaaagtcacagttagtg

SEQ ID NO: 23570 - DNA, 20 bp, Artificial Sequence
  Description of Artificial Sequence: Synthetic oligonucleotide
ttctcaaagtcacagttagt

SEQ ID NO: 23571 - DNA, 20 bp, Artificial Sequence
  Description of Artificial Sequence: Synthetic oligonucleotide
cttctcaaagtcacagttag

SEQ ID NO: 23572 - DNA, 20 bp, Artificial Sequence
  Description of Artificial Sequence: Synthetic oligonucleotide
tcttctcaaagtcacagtta

SEQ ID NO: 23573 - DNA, 20 bp, Artificial Sequence
  Description of Artificial Sequence: Synthetic oligonucleotide
atcttctcaaagtcacagtt

SEQ ID NO: 23574 - DNA, 20 bp, Artificial Sequence
  Description of Artificial Sequence: Synthetic oligonucleotide
aatcttctcaaagtcacagt

SEQ ID NO: 23575 - DNA, 20 bp, Artificial Sequence
  Description of Artificial Sequence: Synthetic oligonucleotide
taatcttctcaaagtcacag

SEQ ID NO: 23576 - DNA, 20 bp, Artificial Sequence
  Description of Artificial Sequence: Synthetic oligonucleotide
ttaatcttctcaaagtcaca

SEQ ID NO: 23577 - DNA, 20 bp, Artificial Sequence
  Description of Artificial Sequence: Synthetic oligonucleotide
tttaatcttctcaaagtcac

SEQ ID NO: 23578 - DNA, 20 bp, Artificial Sequence
  Description of Artificial Sequence: Synthetic oligonucleotide
ctttaatcttctcaaagtca

SEQ ID NO: 23579 - DNA, 20 bp, Artificial Sequence
  Description of Artificial Sequence: Synthetic oligonucleotide
gctttaatcttctcaaagtc

SEQ ID NO: 23580 - DNA, 20 bp, Artificial Sequence
  Description of Artificial Sequence: Synthetic oligonucleotide
tgctttaatcttctcaaagt

SEQ ID NO: 23581 - DNA, 20 bp, Artificial Sequence
  Description of Artificial Sequence: Synthetic oligonucleotide
ctgctttaatcttctcaaag

SEQ ID NO: 23582 - DNA, 20 bp, Artificial Sequence
  Description of Artificial Sequence: Synthetic oligonucleotide
gctgctttaatcttctcaaa

SEQ ID NO: 23583 - DNA, 20 bp, Artificial Sequence
  Description of Artificial Sequence: Synthetic oligonucleotide
ggctgctttaatcttctcaa

SEQ ID NO: 23584 - DNA, 20 bp, Artificial Sequence
  Description of Artificial Sequence: Synthetic oligonucleotide
aggctgctttaatcttctca

SEQ ID NO: 23585 - DNA, 20 bp, Artificial Sequence
  Description of Artificial Sequence: Synthetic oligonucleotide
taggctgctttaatcttctc

SEQ ID NO: 23586 - DNA, 20 bp, Artificial Sequence
  Description of Artificial Sequence: Synthetic oligonucleotide
ataggctgctttaatcttct

SEQ ID NO: 23587 - DNA, 20 bp, Artificial Sequence
  Description of Artificial Sequence: Synthetic oligonucleotide
gataggctgctttaatcttc

SEQ ID NO: 23588 - DNA, 20 bp, Artificial Sequence
  Description of Artificial Sequence: Synthetic oligonucleotide
agataggctgctttaatctt

SEQ ID NO: 23589 - DNA, 20 bp, Artificial Sequence
  Description of Artificial Sequence: Synthetic oligonucleotide
gagataggctgctttaatct

SEQ ID NO: 23590 - DNA, 20 bp, Artificial Sequence
  Description of Artificial Sequence: Synthetic oligonucleotide
tgagataggctgctttaatc

SEQ ID NO: 23591 - DNA, 20 bp, Artificial Sequence
  Description of Artificial Sequence: Synthetic oligonucleotide
ctgagataggctgctttaat

SEQ ID NO: 23592 - DNA, 20 bp, Artificial Sequence
  Description of Artificial Sequence: Synthetic oligonucleotide
actgagataggctgctttaa

SEQ ID NO: 23593 - DNA, 20 bp, Artificial Sequence
  Description of Artificial Sequence: Synthetic oligonucleotide
tactgagataggctgcttta

SEQ ID NO: 23594 - DNA, 20 bp, Artificial Sequence
  Description of Artificial Sequence: Synthetic oligonucleotide
gtactgagataggctgcttt

SEQ ID NO: 23595 - DNA, 20 bp, Artificial Sequence
  Description of Artificial Sequence: Synthetic oligonucleotide
agtactgagataggctgctt

SEQ ID NO: 23596 - DNA, 20 bp, Artificial Sequence
  Description of Artificial Sequence: Synthetic oligonucleotide
tagtactgagataggctgct

SEQ ID NO: 23597 - DNA, 20 bp, Artificial Sequence
  Description of Artificial Sequence: Synthetic oligonucleotide
atagtactgagataggctgc

SEQ ID NO: 23598 - DNA, 20 bp, Artificial Sequence
  Description of Artificial Sequence: Synthetic oligonucleotide
aatagtactgagataggctg

SEQ ID NO: 23599 - DNA, 20 bp, Artificial Sequence
  Description of Artificial Sequence: Synthetic oligonucleotide
aaatagtactgagataggct

SEQ ID NO: 23600 - DNA, 20 bp, Artificial Sequence
  Description of Artificial Sequence: Synthetic oligonucleotide
gaaatagtactgagataggc

SEQ ID NO: 23601 - DNA, 20 bp, Artificial Sequence
  Description of Artificial Sequence: Synthetic oligonucleotide
agaaatagtactgagatagg

SEQ ID NO: 23602 - DNA, 20 bp, Artificial Sequence
  Description of Artificial Sequence: Synthetic oligonucleotide
tagaaatagtactgagatag

SEQ ID NO: 23603 - DNA, 20 bp, Artificial Sequence
  Description of Artificial Sequence: Synthetic oligonucleotide
ttagaaatagtactgagata

SEQ ID NO: 23604 - DNA, 20 bp, Artificial Sequence
  Description of Artificial Sequence: Synthetic oligonucleotide
tttagaaatagtactgagat

SEQ ID NO: 23605 - DNA, 20 bp, Artificial Sequence
  Description of Artificial Sequence: Synthetic oligonucleotide
ctttagaaatagtactgaga

SEQ ID NO: 23606 - DNA, 20 bp, Artificial Sequence
  Description of Artificial Sequence: Synthetic oligonucleotide
tctttagaaatagtactgag

SEQ ID NO: 23607 - DNA, 20 bp, Artificial Sequence
  Description of Artificial Sequence: Synthetic oligonucleotide
gtctttagaaatagtactga

SEQ ID NO: 23608 - DNA, 20 bp, Artificial Sequence
  Description of Artificial Sequence: Synthetic oligonucleotide
ggtctttagaaatagtactg

SEQ ID NO: 23609 - DNA, 20 bp, Artificial Sequence
  Description of Artificial Sequence: Synthetic oligonucleotide
aggtctttagaaatagtact

SEQ ID NO: 23610 - DNA, 20 bp, Artificial Sequence
  Description of Artificial Sequence: Synthetic oligonucleotide
caggtctttagaaatagtac

SEQ ID NO: 23611 - DNA, 20 bp, Artificial Sequence
  Description of Artificial Sequence: Synthetic oligonucleotide
tcaggtctttagaaatagta

SEQ ID NO: 23612 - DNA, 20 bp, Artificial Sequence
  Description of Artificial Sequence: Synthetic oligonucleotide
atcaggtctttagaaatagt

SEQ ID NO: 23613 - DNA, 20 bp, Artificial Sequence
  Description of Artificial Sequence: Synthetic oligonucleotide
aatcaggtctttagaaatag

SEQ ID NO: 23614 - DNA, 20 bp, Artificial Sequence
  Description of Artificial Sequence: Synthetic oligonucleotide
taatcaggtctttagaaata

SEQ ID NO: 23615 - DNA, 20 bp, Artificial Sequence
  Description of Artificial Sequence: Synthetic oligonucleotide
gtaatcaggtctttagaaat

SEQ ID NO: 23616 - DNA, 20 bp, Artificial Sequence
  Description of Artificial Sequence: Synthetic oligonucleotide
tgtaatcaggtctttagaaa

SEQ ID NO: 23617 - DNA, 20 bp, Artificial Sequence
  Description of Artificial Sequence: Synthetic oligonucleotide
atgtaatcaggtctttagaa

SEQ ID NO: 23618 - DNA, 20 bp, Artificial Sequence
  Description of Artificial Sequence: Synthetic oligonucleotide
tatgtaatcaggtctttaga

SEQ ID NO: 23619 - DNA, 20 bp, Artificial Sequence
  Description of Artificial Sequence: Synthetic oligonucleotide
atatgtaatcaggtctttag

SEQ ID NO: 23620 - DNA, 20 bp, Artificial Sequence
  Description of Artificial Sequence: Synthetic oligonucleotide
tatatgtaatcaggtcttta

SEQ ID NO: 23621 - DNA, 20 bp, Artificial Sequence
  Description of Artificial Sequence: Synthetic oligonucleotide
atatatgtaatcaggtcttt

SEQ ID NO: 23622 - DNA, 20 bp, Artificial Sequence
  Description of Artificial Sequence: Synthetic oligonucleotide
catatatgtaatcaggtctt

SEQ ID NO: 23623 - DNA, 20 bp, Artificial Sequence
  Description of Artificial Sequence: Synthetic oligonucleotide
tcatatatgtaatcaggtct

SEQ ID NO: 23624 - DNA, 20 bp, Artificial Sequence
  Description of Artificial Sequence: Synthetic oligonucleotide
ctcatatatgtaatcaggtc

SEQ ID NO: 23625 - DNA, 20 bp, Artificial Sequence
  Description of Artificial Sequence: Synthetic oligonucleotide
actcatatatgtaatcaggt

SEQ ID NO: 23626 - DNA, 20 bp, Artificial Sequence
  Description of Artificial Sequence: Synthetic oligonucleotide
cactcatatatgtaatcagg

SEQ ID NO: 23627 - DNA, 20 bp, Artificial Sequence
  Description of Artificial Sequence: Synthetic oligonucleotide
ccactcatatatgtaatcag

SEQ ID NO: 23628 - DNA, 20 bp, Artificial Sequence
  Description of Artificial Sequence: Synthetic oligonucleotide
cccactcatatatgtaatca

SEQ ID NO: 23629 - DNA, 20 bp, Artificial Sequence
  Description of Artificial Sequence: Synthetic oligonucleotide
tcccactcatatatgtaatc

SEQ ID NO: 23630 - DNA, 20 bp, Artificial Sequence
  Description of Artificial Sequence: Synthetic oligonucleotide
gtcccactcatatatgtaat

SEQ ID NO: 23631 - DNA, 20 bp, Artificial Sequence
  Description of Artificial Sequence: Synthetic oligonucleotide
ggtcccactcatatatgtaa

SEQ ID NO: 23632 - DNA, 20 bp, Artificial Sequence
  Description of Artificial Sequence: Synthetic oligonucleotide
tggtcccactcatatatgta

SEQ ID NO: 23633 - DNA, 20 bp, Artificial Sequence
  Description of Artificial Sequence: Synthetic oligonucleotide
ttggtcccactcatatatgt

SEQ ID NO: 23634 - DNA, 20 bp, Artificial Sequence
  Description of Artificial Sequence: Synthetic oligonucleotide
tttggtcccactcatatatg

SEQ ID NO: 23635 - DNA, 20 bp, Artificial Sequence
  Description of Artificial Sequence: Synthetic oligonucleotide
ttttggtcccactcatatat

SEQ ID NO: 23636 - DNA, 20 bp, Artificial Sequence
  Description of Artificial Sequence: Synthetic oligonucleotide
cttttggtcccactcatata

SEQ ID NO: 23637 - DNA, 20 bp, Artificial Sequence
  Description of Artificial Sequence: Synthetic oligonucleotide
acttttggtcccactcatat

SEQ ID NO: 23638 - DNA, 20 bp, Artificial Sequence
  Description of Artificial Sequence: Synthetic oligonucleotide
tacttttggtcccactcata

SEQ ID NO: 23639 - DNA, 20 bp, Artificial Sequence
  Description of Artificial Sequence: Synthetic oligonucleotide
gtacttttggtcccactcat

SEQ ID NO: 23640 - DNA, 20 bp, Artificial Sequence
  Description of Artificial Sequence: Synthetic oligonucleotide
ggtacttttggtcccactca

SEQ ID NO: 23641 - DNA, 20 bp, Artificial Sequence
  Description of Artificial Sequence: Synthetic oligonucleotide
cggtacttttggtcccactc

SEQ ID NO: 23642 - DNA, 20 bp, Artificial Sequence
  Description of Artificial Sequence: Synthetic oligonucleotide
tcggtacttttggtcccact

SEQ ID NO: 23643 - DNA, 20 bp, Artificial Sequence
  Description of Artificial Sequence: Synthetic oligonucleotide
ctcggtacttttggtcccac

SEQ ID NO: 23644 - DNA, 20 bp, Artificial Sequence
  Description of Artificial Sequence: Synthetic oligonucleotide
actcggtacttttggtccca

SEQ ID NO: 23645 - DNA, 20 bp, Artificial Sequence
  Description of Artificial Sequence: Synthetic oligonucleotide
aactcggtacttttggtccc

SEQ ID NO: 23646 - DNA, 20 bp, Artificial Sequence
  Description of Artificial Sequence: Synthetic oligonucleotide
gaactcggtacttttggtcc

SEQ ID NO: 23647 - DNA, 20 bp, Artificial Sequence
  Description of Artificial Sequence: Synthetic oligonucleotide
tgaactcggtacttttggtc

SEQ ID NO: 23648 - DNA, 20 bp, Artificial Sequence
  Description of Artificial Sequence: Synthetic oligonucleotide
ttgaactcggtacttttggt

SEQ ID NO: 23649 - DNA, 20 bp, Artificial Sequence
  Description of Artificial Sequence: Synthetic oligonucleotide
gttgaactcggtacttttgg

SEQ ID NO: 23650 - DNA, 20 bp, Artificial Sequence
  Description of Artificial Sequence: Synthetic oligonucleotide
tgttgaactcggtacttttg

SEQ ID NO: 23651 - DNA, 20 bp, Artificial Sequence
  Description of Artificial Sequence: Synthetic oligonucleotide
ttgttgaactcggtactttt

SEQ ID NO: 23652 - DNA, 20 bp, Artificial Sequence
  Description of Artificial Sequence: Synthetic oligonucleotide
gttgttgaactcggtacttt

SEQ ID NO: 23653 - DNA, 20 bp, Artificial Sequence
  Description of Artificial Sequence: Synthetic oligonucleotide
tgttgttgaactcggtactt

SEQ ID NO: 23654 - DNA, 20 bp, Artificial Sequence
  Description of Artificial Sequence: Synthetic oligonucleotide
gtgttgttgaactcggtact

SEQ ID NO: 23655 - DNA, 20 bp, Artificial Sequence
  Description of Artificial Sequence: Synthetic oligonucleotide
ggtgttgttgaactcggtac

SEQ ID NO: 23656 - DNA, 20 bp, Artificial Sequence
  Description of Artificial Sequence: Synthetic oligonucleotide
cggtgttgttgaactcggta

SEQ ID NO: 23657 - DNA, 20 bp, Artificial Sequence
  Description of Artificial Sequence: Synthetic oligonucleotide
acggtgttgttgaactcggt

SEQ ID NO: 23658 - DNA, 20 bp, Artificial Sequence
  Description of Artificial Sequence: Synthetic oligonucleotide
gacggtgttgttgaactcgg

SEQ ID NO: 23659 - DNA, 20 bp, Artificial Sequence
  Description of Artificial Sequence: Synthetic oligonucleotide
agacggtgttgttgaactcg

SEQ ID NO: 23660 - DNA, 20 bp, Artificial Sequence
  Description of Artificial Sequence: Synthetic oligonucleotide
gagacggtgttgttgaactc

SEQ ID NO: 23661 - DNA, 20 bp, Artificial Sequence
  Description of Artificial Sequence: Synthetic oligonucleotide
agagacggtgttgttgaact

SEQ ID NO: 23662 - DNA, 20 bp, Artificial Sequence
  Description of Artificial Sequence: Synthetic oligonucleotide
aagagacggtgttgttgaac

SEQ ID NO: 23663 - DNA, 20 bp, Artificial Sequence
  Description of Artificial Sequence: Synthetic oligonucleotide
caagagacggtgttgttgaa

SEQ ID NO: 23664 - DNA, 20 bp, Artificial Sequence
  Description of Artificial Sequence: Synthetic oligonucleotide
acaagagacggtgttgttga

SEQ ID NO: 23665 - DNA, 20 bp, Artificial Sequence
  Description of Artificial Sequence: Synthetic oligonucleotide
tacaagagacggtgttgttg

SEQ ID NO: 23666 - DNA, 20 bp, Artificial Sequence
  Description of Artificial Sequence: Synthetic oligonucleotide
ctacaagagacggtgttgtt

SEQ ID NO: 23667 - DNA, 20 bp, Artificial Sequence
  Description of Artificial Sequence: Synthetic oligonucleotide
gctacaagagacggtgttgt

SEQ ID NO: 23668 - DNA, 20 bp, Artificial Sequence
  Description of Artificial Sequence: Synthetic oligonucleotide
tgctacaagagacggtgttg

SEQ ID NO: 23669 - DNA, 20 bp, Artificial Sequence
  Description of Artificial Sequence: Synthetic oligonucleotide
ttgctacaagagacggtgtt

SEQ ID NO: 23670 - DNA, 20 bp, Artificial Sequence
  Description of Artificial Sequence: Synthetic oligonucleotide
attgctacaagagacggtgt

SEQ ID NO: 23671 - DNA, 20 bp, Artificial Sequence
  Description of Artificial Sequence: Synthetic oligonucleotide
gattgctacaagagacggtg

SEQ ID NO: 23672 - DNA, 20 bp, Artificial Sequence
  Description of Artificial Sequence: Synthetic oligonucleotide
cgattgctacaagagacggt

SEQ ID NO: 23673 - DNA, 20 bp, Artificial Sequence
  Description of Artificial Sequence: Synthetic oligonucleotide
ccgattgctacaagagacgg

SEQ ID NO: 23674 - DNA, 20 bp, Artificial Sequence
  Description of Artificial Sequence: Synthetic oligonucleotide
gccgattgctacaagagacg

SEQ ID NO: 23675 - DNA, 20 bp, Artificial Sequence
  Description of Artificial Sequence: Synthetic oligonucleotide
ggccgattgctacaagagac

SEQ ID NO: 23676 - DNA, 20 bp, Artificial Sequence
  Description of Artificial Sequence: Synthetic oligonucleotide
tggccgattgctacaagaga

SEQ ID NO: 23677 - DNA, 20 bp, Artificial Sequence
  Description of Artificial Sequence: Synthetic oligonucleotide
gtggccgattgctacaagag

SEQ ID NO: 23678 - DNA, 20 bp, Artificial Sequence
  Description of Artificial Sequence: Synthetic oligonucleotide
tgtggccgattgctacaaga

SEQ ID NO: 23679 - DNA, 20 bp, Artificial Sequence
  Description of Artificial Sequence: Synthetic oligonucleotide
atgtggccgattgctacaag

SEQ ID NO: 23680 - DNA, 20 bp, Artificial Sequence
  Description of Artificial Sequence: Synthetic oligonucleotide
aatgtggccgattgctacaa

SEQ ID NO: 23681 - DNA, 20 bp, Artificial Sequence
  Description of Artificial Sequence: Synthetic oligonucleotide
caatgtggccgattgctaca

SEQ ID NO: 23682 - DNA, 20 bp, Artificial Sequence
  Description of Artificial Sequence: Synthetic oligonucleotide
gcaatgtggccgattgctac

SEQ ID NO: 23683 - DNA, 20 bp, Artificial Sequence
  Description of Artificial Sequence: Synthetic oligonucleotide
ggcaatgtggccgattgcta

SEQ ID NO: 23684 - DNA, 20 bp, Artificial Sequence
  Description of Artificial Sequence: Synthetic oligonucleotide
aggcaatgtggccgattgct

SEQ ID NO: 23685 - DNA, 20 bp, Artificial Sequence
  Description of Artificial Sequence: Synthetic oligonucleotide
aaggcaatgtggccgattgc

SEQ ID NO: 23686 - DNA, 20 bp, Artificial Sequence
  Description of Artificial Sequence: Synthetic oligonucleotide
taaggcaatgtggccgattg

SEQ ID NO: 23687 - DNA, 20 bp, Artificial Sequence
  Description of Artificial Sequence: Synthetic oligonucleotide
gtaaggcaatgtggccgatt

SEQ ID NO: 23688 - DNA, 20 bp, Artificial Sequence
  Description of Artificial Sequence: Synthetic oligonucleotide
agtaaggcaatgtggccgat

SEQ ID NO: 23689 - DNA, 20 bp, Artificial Sequence
  Description of Artificial Sequence: Synthetic oligonucleotide
cagtaaggcaatgtggccga

SEQ ID NO: 23690 - DNA, 20 bp, Artificial Sequence
  Description of Artificial Sequence: Synthetic oligonucleotide
tcagtaaggcaatgtggccg

SEQ ID NO: 23691 - DNA, 20 bp, Artificial Sequence
  Description of Artificial Sequence: Synthetic oligonucleotide
ttcagtaaggcaatgtggcc

SEQ ID NO: 23692 - DNA, 20 bp, Artificial Sequence
  Description of Artificial Sequence: Synthetic oligonucleotide
tttcagtaaggcaatgtggc

SEQ ID NO: 23693 - DNA, 20 bp, Artificial Sequence
  Description of Artificial Sequence: Synthetic oligonucleotide
atttcagtaaggcaatgtgg

SEQ ID NO: 23694 - DNA, 20 bp, Artificial Sequence
  Description of Artificial Sequence: Synthetic oligonucleotide
gatttcagtaaggcaatgtg

SEQ ID NO: 23695 - DNA, 20 bp, Artificial Sequence
  Description of Artificial Sequence: Synthetic oligonucleotide
ggatttcagtaaggcaatgt

SEQ ID NO: 23696 - DNA, 20 bp, Artificial Sequence
  Description of Artificial Sequence: Synthetic oligonucleotide
tggatttcagtaaggcaatg

SEQ ID NO: 23697 - DNA, 20 bp, Artificial Sequence
  Description of Artificial Sequence: Synthetic oligonucleotide
ctggatttcagtaaggcaat

SEQ ID NO: 23698 - DNA, 20 bp, Artificial Sequence
  Description of Artificial Sequence: Synthetic oligonucleotide
tctggatttcagtaaggcaa

SEQ ID NO: 23699 - DNA, 20 bp, Artificial Sequence
  Description of Artificial Sequence: Synthetic oligonucleotide
ctctggatttcagtaaggca

SEQ ID NO: 23700 - DNA, 20 bp, Artificial Sequence
  Description of Artificial Sequence: Synthetic oligonucleotide
gctctggatttcagtaaggc

SEQ ID NO: 23701 - DNA, 20 bp, Artificial Sequence
  Description of Artificial Sequence: Synthetic oligonucleotide
ggctctggatttcagtaagg

SEQ ID NO: 23702 - DNA, 20 bp, Artificial Sequence
  Description of Artificial Sequence: Synthetic oligonucleotide
aggctctggatttcagtaag

SEQ ID NO: 23703 - DNA, 20 bp, Artificial Sequence
  Description of Artificial Sequence: Synthetic oligonucleotide
taggctctggatttcagtaa

SEQ ID NO: 23704 - DNA, 20 bp, Artificial Sequence
  Description of Artificial Sequence: Synthetic oligonucleotide
ttaggctctggatttcagta

SEQ ID NO: 23705 - DNA, 20 bp, Artificial Sequence
  Description of Artificial Sequence: Synthetic oligonucleotide
gttaggctctggatttcagt

SEQ ID NO: 23706 - DNA, 20 bp, Artificial Sequence
  Description of Artificial Sequence: Synthetic oligonucleotide
ggttaggctctggatttcag

SEQ ID NO: 23707 - DNA, 20 bp, Artificial Sequence
  Description of Artificial Sequence: Synthetic oligonucleotide
aggttaggctctggatttca

SEQ ID NO: 23708 - DNA, 20 bp, Artificial Sequence
  Description of Artificial Sequence: Synthetic oligonucleotide
aaggttaggctctggatttc

SEQ ID NO: 23709 - DNA, 20 bp, Artificial Sequence
  Description of Artificial Sequence: Synthetic oligonucleotide
gaaggttaggctctggattt

SEQ ID NO: 23710 - DNA, 20 bp, Artificial Sequence
  Description of Artificial Sequence: Synthetic oligonucleotide
tgaaggttaggctctggatt

SEQ ID NO: 23711 - DNA, 20 bp, Artificial Sequence
  Description of Artificial Sequence: Synthetic oligonucleotide
ttgaaggttaggctctggat

SEQ ID NO: 23712 - DNA, 20 bp, Artificial Sequence
  Description of Artificial Sequence: Synthetic oligonucleotide
attgaaggttaggctctgga

SEQ ID NO: 23713 - DNA, 20 bp, Artificial Sequence
  Description of Artificial Sequence: Synthetic oligonucleotide
gattgaaggttaggctctgg

SEQ ID NO: 23714 - DNA, 20 bp, Artificial Sequence
  Description of Artificial Sequence: Synthetic oligonucleotide
ggattgaaggttaggctctg

SEQ ID NO: 23715 - DNA, 20 bp, Artificial Sequence
  Description of Artificial Sequence: Synthetic oligonucleotide
gggattgaaggttaggctct

SEQ ID NO: 23716 - DNA, 20 bp, Artificial Sequence
  Description of Artificial Sequence: Synthetic oligonucleotide
tgggattgaaggttaggctc

SEQ ID NO: 23717 - DNA, 20 bp, Artificial Sequence
  Description of Artificial Sequence: Synthetic oligonucleotide
gtgggattgaaggttaggct

SEQ ID NO: 23718 - DNA, 20 bp, Artificial Sequence
  Description of Artificial Sequence: Synthetic oligonucleotide
ggtgggattgaaggttaggc

SEQ ID NO: 23719 - DNA, 20 bp, Artificial Sequence
  Description of Artificial Sequence: Synthetic oligonucleotide
cggtgggattgaaggttagg

SEQ ID NO: 23720 - DNA, 20 bp, Artificial Sequence
  Description of Artificial Sequence: Synthetic oligonucleotide
gcggtgggattgaaggttag

SEQ ID NO: 23721 - DNA, 20 bp, Artificial Sequence
  Description of Artificial Sequence: Synthetic oligonucleotide
ggcggtgggattgaaggtta

SEQ ID NO: 23722 - DNA, 20 bp, Artificial Sequence
  Description of Artificial Sequence: Synthetic oligonucleotide
cggcggtgggattgaaggtt

SEQ ID NO: 23723 - DNA, 20 bp, Artificial Sequence
  Description of Artificial Sequence: Synthetic oligonucleotide
ccggcggtgggattgaaggt

SEQ ID NO: 23724 - DNA, 20 bp, Artificial Sequence
  Description of Artificial Sequence: Synthetic oligonucleotide
gccggcggtgggattgaagg

SEQ ID NO: 23725 - DNA, 20 bp, Artificial Sequence
  Description of Artificial Sequence: Synthetic oligonucleotide
agccggcggtgggattgaag

SEQ ID NO: 23726 - DNA, 20 bp, Artificial Sequence
  Description of Artificial Sequence: Synthetic oligonucleotide
cagccggcggtgggattgaa

SEQ ID NO: 23727 - DNA, 20 bp, Artificial Sequence
  Description of Artificial Sequence: Synthetic oligonucleotide
gcagccggcggtgggattga

SEQ ID NO: 23728 - DNA, 20 bp, Artificial Sequence
  Description of Artificial Sequence: Synthetic oligonucleotide
cgcagccggcggtgggattg

SEQ ID NO: 23729 - DNA, 20 bp, Artificial Sequence
  Description of Artificial Sequence: Synthetic oligonucleotide
gcgcagccggcggtgggatt

SEQ ID NO: 23730 - DNA, 20 bp, Artificial Sequence
  Description of Artificial Sequence: Synthetic oligonucleotide
cgcgcagccggcggtgggat

SEQ ID NO: 23731 - DNA, 20 bp, Artificial Sequence
  Description of Artificial Sequence: Synthetic oligonucleotide
acgcgcagccggcggtggga

SEQ ID NO: 23732 - DNA, 20 bp, Artificial Sequence
  Description of Artificial Sequence: Synthetic oligonucleotide
gacgcgcagccggcggtggg

SEQ ID NO: 23733 - DNA, 20 bp, Artificial Sequence
  Description of Artificial Sequence: Synthetic oligonucleotide
cgacgcgcagccggcggtgg

SEQ ID NO: 23734 - DNA, 20 bp, Artificial Sequence
  Description of Artificial Sequence: Synthetic oligonucleotide
gcgacgcgcagccggcggtg

SEQ ID NO: 23735 - DNA, 20 bp, Artificial Sequence
  Description of Artificial Sequence: Synthetic oligonucleotide
agcgacgcgcagccggcggt

SEQ ID NO: 23736 - DNA, 20 bp, Artificial Sequence
  Description of Artificial Sequence: Synthetic oligonucleotide
gagcgacgcgcagccggcgg

SEQ ID NO: 23737 - DNA, 20 bp, Artificial Sequence
  Description of Artificial Sequence: Synthetic oligonucleotide
cgagcgacgcgcagccggcg

SEQ ID NO: 23738 - DNA, 20 bp, Artificial Sequence
  Description of Artificial Sequence: Synthetic oligonucleotide
gcgagcgacgcgcagccggc

SEQ ID NO: 23739 - DNA, 20 bp, Artificial Sequence
  Description of Artificial Sequence: Synthetic oligonucleotide
ggcgagcgacgcgcagccgg

SEQ ID NO: 23740 - DNA, 20 bp, Artificial Sequence
  Description of Artificial Sequence: Synthetic oligonucleotide
tggcgagcgacgcgcagccg

SEQ ID NO: 23741 - DNA, 20 bp, Artificial Sequence
  Description of Artificial Sequence: Synthetic oligonucleotide
ttggcgagcgacgcgcagcc

SEQ ID NO: 23742 - DNA, 20 bp, Artificial Sequence
  Description of Artificial Sequence: Synthetic oligonucleotide
tttggcgagcgacgcgcagc

SEQ ID NO: 23743 - DNA, 20 bp, Artificial Sequence
  Description of Artificial Sequence: Synthetic oligonucleotide
ctttggcgagcgacgcgcag

SEQ ID NO: 23744 - DNA, 20 bp, Artificial Sequence
  Description of Artificial Sequence: Synthetic oligonucleotide
tctttggcgagcgacgcgca

SEQ ID NO: 23745 - DNA, 20 bp, Artificial Sequence
  Description of Artificial Sequence: Synthetic oligonucleotide
ttctttggcgagcgacgcgc

SEQ ID NO: 23746 - DNA, 20 bp, Artificial Sequence
  Description of Artificial Sequence: Synthetic oligonucleotide
tttctttggcgagcgacgcg

SEQ ID NO: 23747 - DNA, 20 bp, Artificial Sequence
  Description of Artificial Sequence: Synthetic oligonucleotide
atttctttggcgagcgacgc

SEQ ID NO: 23748 - DNA, 20 bp, Artificial Sequence
  Description of Artificial Sequence: Synthetic oligonucleotide
catttctttggcgagcgacg

SEQ ID NO: 23749 - DNA, 20 bp, Artificial Sequence
  Description of Artificial Sequence: Synthetic oligonucleotide
acatttctttggcgagcgac

SEQ ID NO: 23750 - DNA, 20 bp, Artificial Sequence
  Description of Artificial Sequence: Synthetic oligonucleotide
aacatttctttggcgagcga

SEQ ID NO: 23751 - DNA, 20 bp, Artificial Sequence
  Description of Artificial Sequence: Synthetic oligonucleotide
gaacatttctttggcgagcg

SEQ ID NO: 23752 - DNA, 20 bp, Artificial Sequence
  Description of Artificial Sequence: Synthetic oligonucleotide
cgaacatttctttggcgagc

SEQ ID NO: 23753 - DNA, 20 bp, Artificial Sequence
  Description of Artificial Sequence: Synthetic oligonucleotide
gcgaacatttctttggcgag

SEQ ID NO: 23754 - DNA, 20 bp, Artificial Sequence
  Description of Artificial Sequence: Synthetic oligonucleotide
ggcgaacatttctttggcga

SEQ ID NO: 23755 - DNA, 20 bp, Artificial Sequence
  Description of Artificial Sequence: Synthetic oligonucleotide
tggcgaacatttctttggcg

SEQ ID NO: 23756 - DNA, 20 bp, Artificial Sequence
  Description of Artificial Sequence: Synthetic oligonucleotide
atggcgaacatttctttggc

SEQ ID NO: 23757 - DNA, 20 bp, Artificial Sequence
  Description of Artificial Sequence: Synthetic oligonucleotide
catggcgaacatttctttgg

SEQ ID NO: 23758 - DNA, 20 bp, Artificial Sequence
  Description of Artificial Sequence: Synthetic oligonucleotide
tcatggcgaacatttctttg

SEQ ID NO: 23759 - DNA, 20 bp, Artificial Sequence
  Description of Artificial Sequence: Synthetic oligonucleotide
ttcatggcgaacatttcttt

SEQ ID NO: 23760 - DNA, 20 bp, Artificial Sequence
  Description of Artificial Sequence: Synthetic oligonucleotide
tttcatggcgaacatttctt

SEQ ID NO: 23761 - DNA, 20 bp, Artificial Sequence
  Description of Artificial Sequence: Synthetic oligonucleotide
ttttcatggcgaacatttct

SEQ ID NO: 23762 - DNA, 20 bp, Artificial Sequence
  Description of Artificial Sequence: Synthetic oligonucleotide
gttttcatggcgaacatttc

SEQ ID NO: 23763 - DNA, 20 bp, Artificial Sequence
  Description of Artificial Sequence: Synthetic oligonucleotide
agttttcatggcgaacattt

SEQ ID NO: 23764 - DNA, 20 bp, Artificial Sequence
  Description of Artificial Sequence: Synthetic oligonucleotide
tagttttcatggcgaacatt

SEQ ID NO: 23765 - DNA, 20 bp, Artificial Sequence
  Description of Artificial Sequence: Synthetic oligonucleotide
ttagttttcatggcgaacat

SEQ ID NO: 23766 - DNA, 20 bp, Artificial Sequence
  Description of Artificial Sequence: Synthetic oligonucleotide
cttagttttcatggcgaaca

SEQ ID NO: 23767 - DNA, 20 bp, Artificial Sequence
  Description of Artificial Sequence: Synthetic oligonucleotide
ccttagttttcatggcgaac

SEQ ID NO: 23768 - DNA, 20 bp, Artificial Sequence
  Description of Artificial Sequence: Synthetic oligonucleotide
gccttagttttcatggcgaa

SEQ ID NO: 23769 - DNA, 20 bp, Artificial Sequence
  Description of Artificial Sequence: Synthetic oligonucleotide
agccttagttttcatggcga

SEQ ID NO: 23770 - DNA, 20 bp, Artificial Sequence
  Description of Artificial Sequence: Synthetic oligonucleotide
cagccttagttttcatggcg

SEQ ID NO: 23771 - DNA, 20 bp, Artificial Sequence
  Description of Artificial Sequence: Synthetic oligonucleotide
gcagccttagttttcatggc

SEQ ID NO: 23772 - DNA, 20 bp, Artificial Sequence
  Description of Artificial Sequence: Synthetic oligonucleotide
ggcagccttagttttcatgg

SEQ ID NO: 23773 - DNA, 20 bp, Artificial Sequence
  Description of Artificial Sequence: Synthetic oligonucleotide
aggcagccttagttttcatg

SEQ ID NO: 23774 - DNA, 20 bp, Artificial Sequence
  Description of Artificial Sequence: Synthetic oligonucleotide
aaggcagccttagttttcat

SEQ ID NO: 23775 - DNA, 20 bp, Artificial Sequence
  Description of Artificial Sequence: Synthetic oligonucleotide
taaggcagccttagttttca

SEQ ID NO: 23776 - DNA, 20 bp, Artificial Sequence
  Description of Artificial Sequence: Synthetic oligonucleotide
ctaaggcagccttagttttc

SEQ ID NO: 23777 - DNA, 20 bp, Artificial Sequence
  Description of Artificial Sequence: Synthetic oligonucleotide
gctaaggcagccttagtttt

SEQ ID NO: 23778 - DNA, 20 bp, Artificial Sequence
  Description of Artificial Sequence: Synthetic oligonucleotide
agctaaggcagccttagttt

SEQ ID NO: 23779 - DNA, 20 bp, Artificial Sequence
  Description of Artificial Sequence: Synthetic oligonucleotide
tagctaaggcagccttagtt

SEQ ID NO: 23780 - DNA, 20 bp, Artificial Sequence
  Description of Artificial Sequence: Synthetic oligonucleotide
atagctaaggcagccttagt

SEQ ID NO: 23781 - DNA, 20 bp, Artificial Sequence
  Description of Artificial Sequence: Synthetic oligonucleotide
gatagctaaggcagccttag

SEQ ID NO: 23782 - DNA, 20 bp, Artificial Sequence
  Description of Artificial Sequence: Synthetic oligonucleotide
agatagctaaggcagcctta

SEQ ID NO: 23783 - DNA, 20 bp, Artificial Sequence
  Description of Artificial Sequence: Synthetic oligonucleotide
cagatagctaaggcagcctt

SEQ ID NO: 23784 - DNA, 20 bp, Artificial Sequence
  Description of Artificial Sequence: Synthetic oligonucleotide
ccagatagctaaggcagcct

SEQ ID NO: 23785 - DNA, 20 bp, Artificial Sequence
  Description of Artificial Sequence: Synthetic oligonucleotide
accagatagctaaggcagcc

SEQ ID NO: 23786 - DNA, 20 bp, Artificial Sequence
  Description of Artificial Sequence: Synthetic oligonucleotide
caccagatagctaaggcagc

SEQ ID NO: 23787 - DNA, 20 bp, Artificial Sequence
  Description of Artificial Sequence: Synthetic oligonucleotide
gcaccagatagctaaggcag

SEQ ID NO: 23788 - DNA, 20 bp, Artificial Sequence
  Description of Artificial Sequence: Synthetic oligonucleotide
ggcaccagatagctaaggca

SEQ ID NO: 23789 - DNA, 20 bp, Artificial Sequence
  Description of Artificial Sequence: Synthetic oligonucleotide
gggcaccagatagctaaggc

SEQ ID NO: 23790 - DNA, 20 bp, Artificial Sequence
  Description of Artificial Sequence: Synthetic oligonucleotide
tgggcaccagatagctaagg

SEQ ID NO: 23791 - DNA, 20 bp, Artificial Sequence
  Description of Artificial Sequence: Synthetic oligonucleotide
ctgggcaccagatagctaag

SEQ ID NO: 23792 - DNA, 20 bp, Artificial Sequence
  Description of Artificial Sequence: Synthetic oligonucleotide
cctgggcaccagatagctaa

SEQ ID NO: 23793 - DNA, 20 bp, Artificial Sequence
  Description of Artificial Sequence: Synthetic oligonucleotide
gcctgggcaccagatagcta

SEQ ID NO: 23794 - DNA, 20 bp, Artificial Sequence
  Description of Artificial Sequence: Synthetic oligonucleotide
agcctgggcaccagatagct

SEQ ID NO: 23795 - DNA, 20 bp, Artificial Sequence
  Description of Artificial Sequence: Synthetic oligonucleotide
tagcctgggcaccagatagc

SEQ ID NO: 23796 - DNA, 20 bp, Artificial Sequence
  Description of Artificial Sequence: Synthetic oligonucleotide
atagcctgggcaccagatag

SEQ ID NO: 23797 - DNA, 20 bp, Artificial Sequence
  Description of Artificial Sequence: Synthetic oligonucleotide
aatagcctgggcaccagata

SEQ ID NO: 23798 - DNA, 20 bp, Artificial Sequence
  Description of Artificial Sequence: Synthetic oligonucleotide
gaatagcctgggcaccagat

SEQ ID NO: 23799 - DNA, 20 bp, Artificial Sequence
  Description of Artificial Sequence: Synthetic oligonucleotide
cgaatagcctgggcaccaga

SEQ ID NO: 23800 - DNA, 20 bp, Artificial Sequence
  Description of Artificial Sequence: Synthetic oligonucleotide
ccgaatagcctgggcaccag

SEQ ID NO: 23801 - DNA, 20 bp, Artificial Sequence
  Description of Artificial Sequence: Synthetic oligonucleotide
tccgaatagcctgggcacca

SEQ ID NO: 23802 - DNA, 20 bp, Artificial Sequence
  Description of Artificial Sequence: Synthetic oligonucleotide
ttccgaatagcctgggcacc

SEQ ID NO: 23803 - DNA, 20 bp, Artificial Sequence
  Description of Artificial Sequence: Synthetic oligonucleotide
tttccgaatagcctgggcac

SEQ ID NO: 23804 - DNA, 20 bp, Artificial Sequence
  Description of Artificial Sequence: Synthetic oligonucleotide
gtttccgaatagcctgggca

SEQ ID NO: 23805 - DNA, 20 bp, Artificial Sequence
  Description of Artificial Sequence: Synthetic oligonucleotide
agtttccgaatagcctgggc

SEQ ID NO: 23806 - DNA, 20 bp, Artificial Sequence
  Description of Artificial Sequence: Synthetic oligonucleotide
gagtttccgaatagcctggg

SEQ ID NO: 23807 - DNA, 20 bp, Artificial Sequence
  Description of Artificial Sequence: Synthetic oligonucleotide
tgagtttccgaatagcctgg

SEQ ID NO: 23808 - DNA, 20 bp, Artificial Sequence
  Description of Artificial Sequence: Synthetic oligonucleotide
ctgagtttccgaatagcctg

SEQ ID NO: 23809 - DNA, 20 bp, Artificial Sequence
  Description of Artificial Sequence: Synthetic oligonucleotide
tctgagtttccgaatagcct

SEQ ID NO: 23810 - DNA, 20 bp, Artificial Sequence
  Description of Artificial Sequence: Synthetic oligonucleotide
atctgagtttccgaatagcc

SEQ ID NO: 23811 - DNA, 20 bp, Artificial Sequence
  Description of Artificial Sequence: Synthetic oligonucleotide
tatctgagtttccgaatagc

SEQ ID NO: 23812 - DNA, 20 bp, Artificial Sequence
  Description of Artificial Sequence: Synthetic oligonucleotide
ttatctgagtttccgaatag

SEQ ID NO: 23813 - DNA, 20 bp, Artificial Sequence
  Description of Artificial Sequence: Synthetic oligonucleotide
tttatctgagtttccgaata

SEQ ID NO: 23814 - DNA, 20 bp, Artificial Sequence
  Description of Artificial Sequence: Synthetic oligonucleotide
atttatctgagtttccgaat

SEQ ID NO: 23815 - DNA, 20 bp, Artificial Sequence
  Description of Artificial Sequence: Synthetic oligonucleotide
catttatctgagtttccgaa

SEQ ID NO: 23816 - DNA, 20 bp, Artificial Sequence
  Description of Artificial Sequence: Synthetic oligonucleotide
gcatttatctgagtttccga

SEQ ID NO: 23817 - DNA, 20 bp, Artificial Sequence
  Description of Artificial Sequence: Synthetic oligonucleotide
agcatttatctgagtttccg

SEQ ID NO: 23818 - DNA, 20 bp, Artificial Sequence
  Description of Artificial Sequence: Synthetic oligonucleotide
tagcatttatctgagtttcc

SEQ ID NO: 23819 - DNA, 20 bp, Artificial Sequence
  Description of Artificial Sequence: Synthetic oligonucleotide
gtagcatttatctgagtttc

SEQ ID NO: 23820 - DNA, 20 bp, Artificial Sequence
  Description of Artificial Sequence: Synthetic oligonucleotide
agtagcatttatctgagttt

SEQ ID NO: 23821 - DNA, 20 bp, Artificial Sequence
  Description of Artificial Sequence: Synthetic oligonucleotide
gagtagcatttatctgagtt

SEQ ID NO: 23822 - DNA, 20 bp, Artificial Sequence
  Description of Artificial Sequence: Synthetic oligonucleotide
tgagtagcatttatctgagt

SEQ ID NO: 23823 - DNA, 20 bp, Artificial Sequence
  Description of Artificial Sequence: Synthetic oligonucleotide
ctgagtagcatttatctgag

SEQ ID NO: 23824 - DNA, 20 bp, Artificial Sequence
  Description of Artificial Sequence: Synthetic oligonucleotide
cctgagtagcatttatctga

SEQ ID NO: 23825 - DNA, 20 bp, Artificial Sequence
  Description of Artificial Sequence: Synthetic oligonucleotide
gcctgagtagcatttatctg

SEQ ID NO: 23826 - DNA, 20 bp, Artificial Sequence
  Description of Artificial Sequence: Synthetic oligonucleotide
tgcctgagtagcatttatct

SEQ ID NO: 23827 - DNA, 20 bp, Artificial Sequence
  Description of Artificial Sequence: Synthetic oligonucleotide
ttgcctgagtagcatttatc

SEQ ID NO: 23828 - DNA, 20 bp, Artificial Sequence
  Description of Artificial Sequence: Synthetic oligonucleotide
attgcctgagtagcatttat

SEQ ID NO: 23829 - DNA, 20 bp, Artificial Sequence
  Description of Artificial Sequence: Synthetic oligonucleotide
cattgcctgagtagcattta

SEQ ID NO: 23830 - DNA, 20 bp, Artificial Sequence
  Description of Artificial Sequence: Synthetic oligonucleotide
tcattgcctgagtagcattt

SEQ ID NO: 23831 - DNA, 20 bp, Artificial Sequence
  Description of Artificial Sequence: Synthetic oligonucleotide
ttcattgcctgagtagcatt

SEQ ID NO: 23832 - DNA, 20 bp, Artificial Sequence
  Description of Artificial Sequence: Synthetic oligonucleotide
cttcattgcctgagtagcat

SEQ ID NO: 23833 - DNA, 20 bp, Artificial Sequence
  Description of Artificial Sequence: Synthetic oligonucleotide
tcttcattgcctgagtagca

SEQ ID NO: 23834 - DNA, 20 bp, Artificial Sequence
  Description of Artificial Sequence: Synthetic oligonucleotide
ttcttcattgcctgagtagc

SEQ ID NO: 23835 - DNA, 20 bp, Artificial Sequence
  Description of Artificial Sequence: Synthetic oligonucleotide
cttcttcattgcctgagtag

SEQ ID NO: 23836 - DNA, 20 bp, Artificial Sequence
  Description of Artificial Sequence: Synthetic oligonucleotide
tcttcttcattgcctgagta

SEQ ID NO: 23837 - DNA, 20 bp, Artificial Sequence
  Description of Artificial Sequence: Synthetic oligonucleotide
ctcttcttcattgcctgagt

SEQ ID NO: 23838 - DNA, 20 bp, Artificial Sequence
  Description of Artificial Sequence: Synthetic oligonucleotide
cctcttcttcattgcctgag

SEQ ID NO: 23839 - DNA, 20 bp, Artificial Sequence
  Description of Artificial Sequence: Synthetic oligonucleotide
tcctcttcttcattgcctga

SEQ ID NO: 23840 - DNA, 20 bp, Artificial Sequence
  Description of Artificial Sequence: Synthetic oligonucleotide
ctcctcttcttcattgcctg

SEQ ID NO: 23841 - DNA, 20 bp, Artificial Sequence
  Description of Artificial Sequence: Synthetic oligonucleotide
tctcctcttcttcattgcct

SEQ ID NO: 23842 - DNA, 20 bp, Artificial Sequence
  Description of Artificial Sequence: Synthetic oligonucleotide
ttctcctcttcttcattgcc

SEQ ID NO: 23843 - DNA, 20 bp, Artificial Sequence
  Description of Artificial Sequence: Synthetic oligonucleotide
tttctcctcttcttcattgc

SEQ ID NO: 23844 - DNA, 20 bp, Artificial Sequence
  Description of Artificial Sequence: Synthetic oligonucleotide
ttttctcctcttcttcattg

SEQ ID NO: 23845 - DNA, 20 bp, Artificial Sequence
  Description of Artificial Sequence: Synthetic oligonucleotide
tttttctcctcttcttcatt

SEQ ID NO: 23846 - DNA, 20 bp, Artificial Sequence
  Description of Artificial Sequence: Synthetic oligonucleotide
ctttttctcctcttcttcat

SEQ ID NO: 23847 - DNA, 20 bp, Artificial Sequence
  Description of Artificial Sequence: Synthetic oligonucleotide
cctttttctcctcttcttca

SEQ ID NO: 23848 - DNA, 20 bp, Artificial Sequence
  Description of Artificial Sequence: Synthetic oligonucleotide
tcctttttctcctcttcttc

SEQ ID NO: 23849 - DNA, 20 bp, Artificial Sequence
  Description of Artificial Sequence: Synthetic oligonucleotide
ttcctttttctcctcttctt

SEQ ID NO: 23850 - DNA, 20 bp, Artificial Sequence
  Description of Artificial Sequence: Synthetic oligonucleotide
tttcctttttctcctcttct

SEQ ID NO: 23851 - DNA, 20 bp, Artificial Sequence
  Description of Artificial Sequence: Synthetic oligonucleotide
ctttcctttttctcctcttc

SEQ ID NO: 23852 - DNA, 20 bp, Artificial Sequence
  Description of Artificial Sequence: Synthetic oligonucleotide
actttcctttttctcctctt

SEQ ID NO: 23853 - DNA, 20 bp, Artificial Sequence
  Description of Artificial Sequence: Synthetic oligonucleotide
gactttcctttttctcctct

SEQ ID NO: 23854 - DNA, 20 bp, Artificial Sequence
  Description of Artificial Sequence: Synthetic oligonucleotide
tgactttcctttttctcctc

SEQ ID NO: 23855 - DNA, 20 bp, Artificial Sequence
  Description of Artificial Sequence: Synthetic oligonucleotide
gtgactttcctttttctcct

SEQ ID NO: 23856 - DNA, 20 bp, Artificial Sequence
  Description of Artificial Sequence: Synthetic oligonucleotide
tgtgactttcctttttctcc

SEQ ID NO: 23857 - DNA, 20 bp, Artificial Sequence
  Description of Artificial Sequence: Synthetic oligonucleotide
ttgtgactttcctttttctc

SEQ ID NO: 23858 - DNA, 20 bp, Artificial Sequence
  Description of Artificial Sequence: Synthetic oligonucleotide
gttgtgactttcctttttct

SEQ ID NO: 23859 - DNA, 20 bp, Artificial Sequence
  Description of Artificial Sequence: Synthetic oligonucleotide
ggttgtgactttcctttttc

SEQ ID NO: 23860 - DNA, 20 bp, Artificial Sequence
  Description of Artificial Sequence: Synthetic oligonucleotide
tggttgtgactttccttttt

SEQ ID NO: 23861 - DNA, 20 bp, Artificial Sequence
  Description of Artificial Sequence: Synthetic oligonucleotide
ttggttgtgactttcctttt

SEQ ID NO: 23862 - DNA, 20 bp, Artificial Sequence
  Description of Artificial Sequence: Synthetic oligonucleotide
attggttgtgactttccttt

SEQ ID NO: 23863 - DNA, 20 bp, Artificial Sequence
  Description of Artificial Sequence: Synthetic oligonucleotide
tattggttgtgactttcctt

SEQ ID NO: 23864 - DNA, 20 bp, Artificial Sequence
  Description of Artificial Sequence: Synthetic oligonucleotide
ttattggttgtgactttcct

SEQ ID NO: 23865 - DNA, 20 bp, Artificial Sequence
  Description of Artificial Sequence: Synthetic oligonucleotide
tttattggttgtgactttcc

SEQ ID NO: 23866 - DNA, 20 bp, Artificial Sequence
  Description of Artificial Sequence: Synthetic oligonucleotide
atttattggttgtgactttc

SEQ ID NO: 23867 - DNA, 20 bp, Artificial Sequence
  Description of Artificial Sequence: Synthetic oligonucleotide
catttattggttgtgacttt

SEQ ID NO: 23868 - DNA, 20 bp, Artificial Sequence
  Description of Artificial Sequence: Synthetic oligonucleotide
acatttattggttgtgactt

SEQ ID NO: 23869 - DNA, 20 bp, Artificial Sequence
  Description of Artificial Sequence: Synthetic oligonucleotide
gacatttattggttgtgact

SEQ ID NO: 23870 - DNA, 20 bp, Artificial Sequence
  Description of Artificial Sequence: Synthetic oligonucleotide
agacatttattggttgtgac

SEQ ID NO: 23871 - DNA, 20 bp, Artificial Sequence
  Description of Artificial Sequence: Synthetic oligonucleotide
cagacatttattggttgtga

SEQ ID NO: 23872 - DNA, 20 bp, Artificial Sequence
  Description of Artificial Sequence: Synthetic oligonucleotide
ccagacatttattggttgtg

SEQ ID NO: 23873 - DNA, 20 bp, Artificial Sequence
  Description of Artificial Sequence: Synthetic oligonucleotide
tccagacatttattggttgt

SEQ ID NO: 23874 - DNA, 20 bp, Artificial Sequence
  Description of Artificial Sequence: Synthetic oligonucleotide
ttccagacatttattggttg

SEQ ID NO: 23875 - DNA, 20 bp, Artificial Sequence
  Description of Artificial Sequence: Synthetic oligonucleotide
gttccagacatttattggtt

SEQ ID NO: 23876 - DNA, 20 bp, Artificial Sequence
  Description of Artificial Sequence: Synthetic oligonucleotide
tgttccagacatttattggt

SEQ ID NO: 23877 - DNA, 20 bp, Artificial Sequence
  Description of Artificial Sequence: Synthetic oligonucleotide
ttgttccagacatttattgg

SEQ ID NO: 23878 - DNA, 20 bp, Artificial Sequence
  Description of Artificial Sequence: Synthetic oligonucleotide
cttgttccagacatttattg

SEQ ID NO: 23879 - DNA, 20 bp, Artificial Sequence
  Description of Artificial Sequence: Synthetic oligonucleotide
acttgttccagacatttatt

SEQ ID NO: 23880 - DNA, 20 bp, Artificial Sequence
  Description of Artificial Sequence: Synthetic oligonucleotide
cacttgttccagacatttat

SEQ ID NO: 23881 - DNA, 20 bp, Artificial Sequence
  Description of Artificial Sequence: Synthetic oligonucleotide
acacttgttccagacattta

SEQ ID NO: 23882 - DNA, 20 bp, Artificial Sequence
  Description of Artificial Sequence: Synthetic oligonucleotide
gacacttgttccagacattt

SEQ ID NO: 23883 - DNA, 20 bp, Artificial Sequence
  Description of Artificial Sequence: Synthetic oligonucleotide
tgacacttgttccagacatt

SEQ ID NO: 23884 - DNA, 20 bp, Artificial Sequence
  Description of Artificial Sequence: Synthetic oligonucleotide
gtgacacttgttccagacat

SEQ ID NO: 23885 - DNA, 20 bp, Artificial Sequence
  Description of Artificial Sequence: Synthetic oligonucleotide
tgtgacacttgttccagaca

SEQ ID NO: 23886 - DNA, 20 bp, Artificial Sequence
  Description of Artificial Sequence: Synthetic oligonucleotide
ttgtgacacttgttccagac

SEQ ID NO: 23887 - DNA, 20 bp, Artificial Sequence
  Description of Artificial Sequence: Synthetic oligonucleotide
attgtgacacttgttccaga

SEQ ID NO: 23888 - DNA, 20 bp, Artificial Sequence
  Description of Artificial Sequence: Synthetic oligonucleotide
aattgtgacacttgttccag

SEQ ID NO: 23889 - DNA, 20 bp, Artificial Sequence
  Description of Artificial Sequence: Synthetic oligonucleotide
taattgtgacacttgttcca

SEQ ID NO: 23890 - DNA, 20 bp, Artificial Sequence
  Description of Artificial Sequence: Synthetic oligonucleotide
gtaattgtgacacttgttcc

SEQ ID NO: 23891 - DNA, 20 bp, Artificial Sequence
  Description of Artificial Sequence: Synthetic oligonucleotide
tgtaattgtgacacttgttc

SEQ ID NO: 23892 - DNA, 20 bp, Artificial Sequence
  Description of Artificial Sequence: Synthetic oligonucleotide
ttgtaattgtgacacttgtt

SEQ ID NO: 23893 - DNA, 20 bp, Artificial Sequence
  Description of Artificial Sequence: Synthetic oligonucleotide
cttgtaattgtgacacttgt

SEQ ID NO: 23894 - DNA, 20 bp, Artificial Sequence
  Description of Artificial Sequence: Synthetic oligonucleotide
ccttgtaattgtgacacttg

SEQ ID NO: 23895 - DNA, 20 bp, Artificial Sequence
  Description of Artificial Sequence: Synthetic oligonucleotide
tccttgtaattgtgacactt

SEQ ID NO: 23896 - DNA, 20 bp, Artificial Sequence
  Description of Artificial Sequence: Synthetic oligonucleotide
atccttgtaattgtgacact

SEQ ID NO: 23897 - DNA, 20 bp, Artificial Sequence
  Description of Artificial Sequence: Synthetic oligonucleotide
aatccttgtaattgtgacac

SEQ ID NO: 23898 - DNA, 20 bp, Artificial Sequence
  Description of Artificial Sequence: Synthetic oligonucleotide
caatccttgtaattgtgaca

SEQ ID NO: 23899 - DNA, 20 bp, Artificial Sequence
  Description of Artificial Sequence: Synthetic oligonucleotide
acaatccttgtaattgtgac

SEQ ID NO: 23900 - DNA, 20 bp, Artificial Sequence
  Description of Artificial Sequence: Synthetic oligonucleotide
cacaatccttgtaattgtga

SEQ ID NO: 23901 - DNA, 20 bp, Artificial Sequence
  Description of Artificial Sequence: Synthetic oligonucleotide
ccacaatccttgtaattgtg

SEQ ID NO: 23902 - DNA, 20 bp, Artificial Sequence
  Description of Artificial Sequence: Synthetic oligonucleotide
gccacaatccttgtaattgt

SEQ ID NO: 23903 - DNA, 20 bp, Artificial Sequence
  Description of Artificial Sequence: Synthetic oligonucleotide
cgccacaatccttgtaattg

SEQ ID NO: 23904 - DNA, 20 bp, Artificial Sequence
  Description of Artificial Sequence: Synthetic oligonucleotide
acgccacaatccttgtaatt

SEQ ID NO: 23905 - DNA, 20 bp, Artificial Sequence
  Description of Artificial Sequence: Synthetic oligonucleotide
gacgccacaatccttgtaat

SEQ ID NO: 23906 - DNA, 20 bp, Artificial Sequence
  Description of Artificial Sequence: Synthetic oligonucleotide
cgacgccacaatccttgtaa

SEQ ID NO: 23907 - DNA, 20 bp, Artificial Sequence
  Description of Artificial Sequence: Synthetic oligonucleotide
gcgacgccacaatccttgta

SEQ ID NO: 23908 - DNA, 20 bp, Artificial Sequence
  Description of Artificial Sequence: Synthetic oligonucleotide
agcgacgccacaatccttgt

SEQ ID NO: 23909 - DNA, 20 bp, Artificial Sequence
  Description of Artificial Sequence: Synthetic oligonucleotide
aagcgacgccacaatccttg

SEQ ID NO: 23910 - DNA, 20 bp, Artificial Sequence
  Description of Artificial Sequence: Synthetic oligonucleotide
gaagcgacgccacaatcctt

SEQ ID NO: 23911 - DNA, 20 bp, Artificial Sequence
  Description of Artificial Sequence: Synthetic oligonucleotide
tgaagcgacgccacaatcct

SEQ ID NO: 23912 - DNA, 20 bp, Artificial Sequence
  Description of Artificial Sequence: Synthetic oligonucleotide
ttgaagcgacgccacaatcc

SEQ ID NO: 23913 - DNA, 20 bp, Artificial Sequence
  Description of Artificial Sequence: Synthetic oligonucleotide
attgaagcgacgccacaatc

SEQ ID NO: 23914 - DNA, 20 bp, Artificial Sequence
  Description of Artificial Sequence: Synthetic oligonucleotide
gattgaagcgacgccacaat

SEQ ID NO: 23915 - DNA, 20 bp, Artificial Sequence
  Description of Artificial Sequence: Synthetic oligonucleotide
cgattgaagcgacgccacaa

SEQ ID NO: 23916 - DNA, 20 bp, Artificial Sequence
  Description of Artificial Sequence: Synthetic oligonucleotide
tcgattgaagcgacgccaca

SEQ ID NO: 23917 - DNA, 20 bp, Artificial Sequence
  Description of Artificial Sequence: Synthetic oligonucleotide
gtcgattgaagcgacgccac

SEQ ID NO: 23918 - DNA, 20 bp, Artificial Sequence
  Description of Artificial Sequence: Synthetic oligonucleotide
ggtcgattgaagcgacgcca

SEQ ID NO: 23919 - DNA, 20 bp, Artificial Sequence
  Description of Artificial Sequence: Synthetic oligonucleotide
aggtcgattgaagcgacgcc

SEQ ID NO: 23920 - DNA, 20 bp, Artificial Sequence
  Description of Artificial Sequence: Synthetic oligonucleotide
aaggtcgattgaagcgacgc

SEQ ID NO: 23921 - DNA, 20 bp, Artificial Sequence
  Description of Artificial Sequence: Synthetic oligonucleotide
aaaggtcgattgaagcgacg

SEQ ID NO: 23922 - DNA, 20 bp, Artificial Sequence
  Description of Artificial Sequence: Synthetic oligonucleotide
taaaggtcgattgaagcgac

SEQ ID NO: 23923 - DNA, 20 bp, Artificial Sequence
  Description of Artificial Sequence: Synthetic oligonucleotide
gtaaaggtcgattgaagcga

SEQ ID NO: 23924 - DNA, 20 bp, Artificial Sequence
  Description of Artificial Sequence: Synthetic oligonucleotide
agtaaaggtcgattgaagcg

SEQ ID NO: 23925 - DNA, 20 bp, Artificial Sequence
  Description of Artificial Sequence: Synthetic oligonucleotide
cagtaaaggtcgattgaagc

SEQ ID NO: 23926 - DNA, 20 bp, Artificial Sequence
  Description of Artificial Sequence: Synthetic oligonucleotide
tcagtaaaggtcgattgaag

SEQ ID NO: 23927 - DNA, 20 bp, Artificial Sequence
  Description of Artificial Sequence: Synthetic oligonucleotide
ttcagtaaaggtcgattgaa

SEQ ID NO: 23928 - DNA, 20 bp, Artificial Sequence
  Description of Artificial Sequence: Synthetic oligonucleotide
tttcagtaaaggtcgattga

SEQ ID NO: 23929 - DNA, 20 bp, Artificial Sequence
  Description of Artificial Sequence: Synthetic oligonucleotide
gtttcagtaaaggtcgattg

SEQ ID NO: 23930 - DNA, 20 bp, Artificial Sequence
  Description of Artificial Sequence: Synthetic oligonucleotide
tgtttcagtaaaggtcgatt

SEQ ID NO: 23931 - DNA, 20 bp, Artificial Sequence
  Description of Artificial Sequence: Synthetic oligonucleotide
ttgtttcagtaaaggtcgat

SEQ ID NO: 23932 - DNA, 20 bp, Artificial Sequence
  Description of Artificial Sequence: Synthetic oligonucleotide
gttgtttcagtaaaggtcga

SEQ ID NO: 23933 - DNA, 20 bp, Artificial Sequence
  Description of Artificial Sequence: Synthetic oligonucleotide
tgttgtttcagtaaaggtcg

SEQ ID NO: 23934 - DNA, 20 bp, Artificial Sequence
  Description of Artificial Sequence: Synthetic oligonucleotide
ctgttgtttcagtaaaggtc

SEQ ID NO: 23935 - DNA, 20 bp, Artificial Sequence
  Description of Artificial Sequence: Synthetic oligonucleotide
actgttgtttcagtaaaggt

SEQ ID NO: 23936 - DNA, 20 bp, Artificial Sequence
  Description of Artificial Sequence: Synthetic oligonucleotide
tactgttgtttcagtaaagg

SEQ ID NO: 23937 - DNA, 20 bp, Artificial Sequence
  Description of Artificial Sequence: Synthetic oligonucleotide
ttactgttgtttcagtaaag

SEQ ID NO: 23938 - DNA, 20 bp, Artificial Sequence
  Description of Artificial Sequence: Synthetic oligonucleotide
tttactgttgtttcagtaaa

SEQ ID NO: 23939 - DNA, 20 bp, Artificial Sequence
  Description of Artificial Sequence: Synthetic oligonucleotide
gtttactgttgtttcagtaa

SEQ ID NO: 23940 - DNA, 20 bp, Artificial Sequence
  Description of Artificial Sequence: Synthetic oligonucleotide
ggtttactgttgtttcagta

SEQ ID NO: 23941 - DNA, 20 bp, Artificial Sequence
  Description of Artificial Sequence: Synthetic oligonucleotide
tggtttactgttgtttcagt

SEQ ID NO: 23942 - DNA, 20 bp, Artificial Sequence
  Description of Artificial Sequence: Synthetic oligonucleotide
atggtttactgttgtttcag

SEQ ID NO: 23943 - DNA, 20 bp, Artificial Sequence
  Description of Artificial Sequence: Synthetic oligonucleotide
gatggtttactgttgtttca

SEQ ID NO: 23944 - DNA, 20 bp, Artificial Sequence
  Description of Artificial Sequence: Synthetic oligonucleotide
agatggtttactgttgtttc

SEQ ID NO: 23945 - DNA, 20 bp, Artificial Sequence
  Description of Artificial Sequence: Synthetic oligonucleotide
aagatggtttactgttgttt

SEQ ID NO: 23946 - DNA, 20 bp, Artificial Sequence
  Description of Artificial Sequence: Synthetic oligonucleotide
aaagatggtttactgttgtt

SEQ ID NO: 23947 - DNA, 20 bp, Artificial Sequence
  Description of Artificial Sequence: Synthetic oligonucleotide
taaagatggtttactgttgt

SEQ ID NO: 23948 - DNA, 20 bp, Artificial Sequence
  Description of Artificial Sequence: Synthetic oligonucleotide
ataaagatggtttactgttg

SEQ ID NO: 23949 - DNA, 20 bp, Artificial Sequence
  Description of Artificial Sequence: Synthetic oligonucleotide
aataaagatggtttactgtt

SEQ ID NO: 23950 - DNA, 20 bp, Artificial Sequence
  Description of Artificial Sequence: Synthetic oligonucleotide
taataaagatggtttactgt

SEQ ID NO: 23951 - DNA, 20 bp, Artificial Sequence
  Description of Artificial Sequence: Synthetic oligonucleotide
ataataaagatggtttactg

SEQ ID NO: 23952 - DNA, 20 bp, Artificial Sequence
  Description of Artificial Sequence: Synthetic oligonucleotide
cataataaagatggtttact

SEQ ID NO: 23953 - DNA, 20 bp, Artificial Sequence
  Description of Artificial Sequence: Synthetic oligonucleotide
ccataataaagatggtttac

SEQ ID NO: 23954 - DNA, 20 bp, Artificial Sequence
  Description of Artificial Sequence: Synthetic oligonucleotide
accataataaagatggttta

SEQ ID NO: 23955 - DNA, 20 bp, Artificial Sequence
  Description of Artificial Sequence: Synthetic oligonucleotide
gaccataataaagatggttt

SEQ ID NO: 23956 - DNA, 20 bp, Artificial Sequence
  Description of Artificial Sequence: Synthetic oligonucleotide
tgaccataataaagatggtt

SEQ ID NO: 23957 - DNA, 20 bp, Artificial Sequence
  Description of Artificial Sequence: Synthetic oligonucleotide
atgaccataataaagatggt

SEQ ID NO: 23958 - DNA, 20 bp, Artificial Sequence
  Description of Artificial Sequence: Synthetic oligonucleotide
tatgaccataataaagatgg

SEQ ID NO: 23959 - DNA, 20 bp, Artificial Sequence
  Description of Artificial Sequence: Synthetic oligonucleotide
atatgaccataataaagatg

SEQ ID NO: 23960 - DNA, 20 bp, Artificial Sequence
  Description of Artificial Sequence: Synthetic oligonucleotide
aatatgaccataataaagat

SEQ ID NO: 23961 - DNA, 20 bp, Artificial Sequence
  Description of Artificial Sequence: Synthetic oligonucleotide
aaatatgaccataataaaga

SEQ ID NO: 23962 - DNA, 20 bp, Artificial Sequence
  Description of Artificial Sequence: Synthetic oligonucleotide
gaaatatgaccataataaag

SEQ ID NO: 23963 - DNA, 20 bp, Artificial Sequence
  Description of Artificial Sequence: Synthetic oligonucleotide
tgaaatatgaccataataaa

SEQ ID NO: 23964 - DNA, 20 bp, Artificial Sequence
  Description of Artificial Sequence: Synthetic oligonucleotide
gtgaaatatgaccataataa

SEQ ID NO: 23965 - DNA, 20 bp, Artificial Sequence
  Description of Artificial Sequence: Synthetic oligonucleotide
tgtgaaatatgaccataata

SEQ ID NO: 23966 - DNA, 20 bp, Artificial Sequence
  Description of Artificial Sequence: Synthetic oligonucleotide
ctgtgaaatatgaccataat

SEQ ID NO: 23967 - DNA, 20 bp, Artificial Sequence
  Description of Artificial Sequence: Synthetic oligonucleotide
gctgtgaaatatgaccataa

SEQ ID NO: 23968 - DNA, 20 bp, Artificial Sequence
  Description of Artificial Sequence: Synthetic oligonucleotide
tgctgtgaaatatgaccata

SEQ ID NO: 23969 - DNA, 20 bp, Artificial Sequence
  Description of Artificial Sequence: Synthetic oligonucleotide
gtgctgtgaaatatgaccat

SEQ ID NO: 23970 - DNA, 20 bp, Artificial Sequence
  Description of Artificial Sequence: Synthetic oligonucleotide
ggtgctgtgaaatatgacca

SEQ ID NO: 23971 - DNA, 20 bp, Artificial Sequence
  Description of Artificial Sequence: Synthetic oligonucleotide
tggtgctgtgaaatatgacc

SEQ ID NO: 23972 - DNA, 20 bp, Artificial Sequence
  Description of Artificial Sequence: Synthetic oligonucleotide
ttggtgctgtgaaatatgac

SEQ ID NO: 23973 - DNA, 20 bp, Artificial Sequence
  Description of Artificial Sequence: Synthetic oligonucleotide
tttggtgctgtgaaatatga

SEQ ID NO: 23974 - DNA, 20 bp, Artificial Sequence
  Description of Artificial Sequence: Synthetic oligonucleotide
ttttggtgctgtgaaatatg

SEQ ID NO: 23975 - DNA, 20 bp, Artificial Sequence
  Description of Artificial Sequence: Synthetic oligonucleotide
attttggtgctgtgaaatat

SEQ ID NO: 23976 - DNA, 20 bp, Artificial Sequence
  Description of Artificial Sequence: Synthetic oligonucleotide
tattttggtgctgtgaaata

SEQ ID NO: 23977 - DNA, 20 bp, Artificial Sequence
  Description of Artificial Sequence: Synthetic oligonucleotide
ttattttggtgctgtgaaat

SEQ ID NO: 23978 - DNA, 20 bp, Artificial Sequence
  Description of Artificial Sequence: Synthetic oligonucleotide
tttattttggtgctgtgaaa

SEQ ID NO: 23979 - DNA, 20 bp, Artificial Sequence
  Description of Artificial Sequence: Synthetic oligonucleotide
atttattttggtgctgtgaa

SEQ ID NO: 23980 - DNA, 20 bp, Artificial Sequence
  Description of Artificial Sequence: Synthetic oligonucleotide
gatttattttggtgctgtga

SEQ ID NO: 23981 - DNA, 20 bp, Artificial Sequence
  Description of Artificial Sequence: Synthetic oligonucleotide
tgatttattttggtgctgtg

SEQ ID NO: 23982 - DNA, 20 bp, Artificial Sequence
  Description of Artificial Sequence: Synthetic oligonucleotide
atgatttattttggtgctgt

SEQ ID NO: 23983 - DNA, 20 bp, Artificial Sequence
  Description of Artificial Sequence: Synthetic oligonucleotide
gatgatttattttggtgctg

SEQ ID NO: 23984 - DNA, 20 bp, Artificial Sequence
  Description of Artificial Sequence: Synthetic oligonucleotide
agatgatttattttggtgct

SEQ ID NO: 23985 - DNA, 20 bp, Artificial Sequence
  Description of Artificial Sequence: Synthetic oligonucleotide
aagatgatttattttggtgc

SEQ ID NO: 23986 - DNA, 20 bp, Artificial Sequence
  Description of Artificial Sequence: Synthetic oligonucleotide
aaagatgatttattttggtg

SEQ ID NO: 23987 - DNA, 20 bp, Artificial Sequence
  Description of Artificial Sequence: Synthetic oligonucleotide
taaagatgatttattttggt

SEQ ID NO: 23988 - DNA, 20 bp, Artificial Sequence
  Description of Artificial Sequence: Synthetic oligonucleotide
ataaagatgatttattttgg

SEQ ID NO: 23989 - DNA, 20 bp, Artificial Sequence
  Description of Artificial Sequence: Synthetic oligonucleotide
aataaagatgatttattttg

SEQ ID NO: 23990 - DNA, 20 bp, Artificial Sequence
  Description of Artificial Sequence: Synthetic oligonucleotide
taataaagatgatttatttt

SEQ ID NO: 23991 - DNA, 20 bp, Artificial Sequence
  Description of Artificial Sequence: Synthetic oligonucleotide
ttaataaagatgatttattt

SEQ ID NO: 23992 - DNA, 20 bp, Artificial Sequence
  Description of Artificial Sequence: Synthetic oligonucleotide
cttaataaagatgatttatt

SEQ ID NO: 23993 - DNA, 20 bp, Artificial Sequence
  Description of Artificial Sequence: Synthetic oligonucleotide
acttaataaagatgatttat

SEQ ID NO: 23994 - DNA, 20 bp, Artificial Sequence
  Description of Artificial Sequence: Synthetic oligonucleotide
tacttaataaagatgattta

SEQ ID NO: 23995 - DNA, 20 bp, Artificial Sequence
  Description of Artificial Sequence: Synthetic oligonucleotide
ctacttaataaagatgattt

SEQ ID NO: 23996 - DNA, 20 bp, Artificial Sequence
  Description of Artificial Sequence: Synthetic oligonucleotide
tctacttaataaagatgatt

SEQ ID NO: 23997 - DNA, 20 bp, Artificial Sequence
  Description of Artificial Sequence: Synthetic oligonucleotide
atctacttaataaagatgat

SEQ ID NO: 23998 - DNA, 20 bp, Artificial Sequence
  Description of Artificial Sequence: Synthetic oligonucleotide
catctacttaataaagatga

SEQ ID NO: 23999 - DNA, 20 bp, Artificial Sequence
  Description of Artificial Sequence: Synthetic oligonucleotide
tcatctacttaataaagatg

SEQ ID NO: 24000 - DNA, 20 bp, Artificial Sequence
  Description of Artificial Sequence: Synthetic oligonucleotide
ttcatctacttaataaagat

SEQ ID NO: 24001 - DNA, 20 bp, Artificial Sequence
  Description of Artificial Sequence: Synthetic oligonucleotide
tttcatctacttaataaaga

SEQ ID NO: 24002 - DNA, 20 bp, Artificial Sequence
  Description of Artificial Sequence: Synthetic oligonucleotide
gtttcatctacttaataaag

SEQ ID NO: 24003 - DNA, 20 bp, Artificial Sequence
  Description of Artificial Sequence: Synthetic oligonucleotide
tgtttcatctacttaataaa

SEQ ID NO: 24004 - DNA, 20 bp, Artificial Sequence
  Description of Artificial Sequence: Synthetic oligonucleotide
atgtttcatctacttaataa

SEQ ID NO: 24005 - DNA, 20 bp, Artificial Sequence
  Description of Artificial Sequence: Synthetic oligonucleotide
aatgtttcatctacttaata

SEQ ID NO: 24006 - DNA, 20 bp, Artificial Sequence
  Description of Artificial Sequence: Synthetic oligonucleotide
taatgtttcatctacttaat

SEQ ID NO: 24007 - DNA, 20 bp, Artificial Sequence
  Description of Artificial Sequence: Synthetic oligonucleotide
ttaatgtttcatctacttaa

SEQ ID NO: 24008 - DNA, 20 bp, Artificial Sequence
  Description of Artificial Sequence: Synthetic oligonucleotide
gttaatgtttcatctactta

SEQ ID NO: 24009 - DNA, 20 bp, Artificial Sequence
  Description of Artificial Sequence: Synthetic oligonucleotide
agttaatgtttcatctactt

SEQ ID NO: 24010 - DNA, 20 bp, Artificial Sequence
  Description of Artificial Sequence: Synthetic oligonucleotide
gagttaatgtttcatctact

SEQ ID NO: 24011 - DNA, 20 bp, Artificial Sequence
  Description of Artificial Sequence: Synthetic oligonucleotide
agagttaatgtttcatctac

SEQ ID NO: 24012 - DNA, 20 bp, Artificial Sequence
  Description of Artificial Sequence: Synthetic oligonucleotide
tagagttaatgtttcatcta

SEQ ID NO: 24013 - DNA, 20 bp, Artificial Sequence
  Description of Artificial Sequence: Synthetic oligonucleotide
ttagagttaatgtttcatct

SEQ ID NO: 24014 - DNA, 20 bp, Artificial Sequence
  Description of Artificial Sequence: Synthetic oligonucleotide
gttagagttaatgtttcatc

SEQ ID NO: 24015 - DNA, 20 bp, Artificial Sequence
  Description of Artificial Sequence: Synthetic oligonucleotide
agttagagttaatgtttcat

SEQ ID NO: 24016 - DNA, 20 bp, Artificial Sequence
  Description of Artificial Sequence: Synthetic oligonucleotide
cagttagagttaatgtttca

SEQ ID NO: 24017 - DNA, 20 bp, Artificial Sequence
  Description of Artificial Sequence: Synthetic oligonucleotide
acagttagagttaatgtttc

SEQ ID NO: 24018 - DNA, 20 bp, Artificial Sequence
  Description of Artificial Sequence: Synthetic oligonucleotide
cacagttagagttaatgttt

SEQ ID NO: 24019 - DNA, 20 bp, Artificial Sequence
  Description of Artificial Sequence: Synthetic oligonucleotide
tcacagttagagttaatgtt

SEQ ID NO: 24020 - DNA, 20 bp, Artificial Sequence
  Description of Artificial Sequence: Synthetic oligonucleotide
gtcacagttagagttaatgt

SEQ ID NO: 24021 - DNA, 20 bp, Artificial Sequence
  Description of Artificial Sequence: Synthetic oligonucleotide
tgtcacagttagagttaatg

SEQ ID NO: 24022 - DNA, 20 bp, Artificial Sequence
  Description of Artificial Sequence: Synthetic oligonucleotide
ttgtcacagttagagttaat

SEQ ID NO: 24023 - DNA, 20 bp, Artificial Sequence
  Description of Artificial Sequence: Synthetic oligonucleotide
tttgtcacagttagagttaa

SEQ ID NO: 24024 - DNA, 20 bp, Artificial Sequence
  Description of Artificial Sequence: Synthetic oligonucleotide
ctttgtcacagttagagtta

SEQ ID NO: 24025 - DNA, 20 bp, Artificial Sequence
  Description of Artificial Sequence: Synthetic oligonucleotide
tctttgtcacagttagagtt

SEQ ID NO: 24026 - DNA, 20 bp, Artificial Sequence
  Description of Artificial Sequence: Synthetic oligonucleotide
ttctttgtcacagttagagt

SEQ ID NO: 24027 - DNA, 20 bp, Artificial Sequence
  Description of Artificial Sequence: Synthetic oligonucleotide
cttctttgtcacagttagag

SEQ ID NO: 24028 - DNA, 20 bp, Artificial Sequence
  Description of Artificial Sequence: Synthetic oligonucleotide
tcttctttgtcacagttaga

SEQ ID NO: 24029 - DNA, 20 bp, Artificial Sequence
  Description of Artificial Sequence: Synthetic oligonucleotide
gtcttctttgtcacagttag

SEQ ID NO: 24030 - DNA, 20 bp, Artificial Sequence
  Description of Artificial Sequence: Synthetic oligonucleotide
ggtcttctttgtcacagtta

SEQ ID NO: 24031 - DNA, 20 bp, Artificial Sequence
  Description of Artificial Sequence: Synthetic oligonucleotide
tggtcttctttgtcacagtt

SEQ ID NO: 24032 - DNA, 20 bp, Artificial Sequence
  Description of Artificial Sequence: Synthetic oligonucleotide
gtggtcttctttgtcacagt

SEQ ID NO: 24033 - DNA, 20 bp, Artificial Sequence
  Description of Artificial Sequence: Synthetic oligonucleotide
tgtggtcttctttgtcacag

SEQ ID NO: 24034 - DNA, 20 bp, Artificial Sequence
  Description of Artificial Sequence: Synthetic oligonucleotide
ttgtggtcttctttgtcaca

SEQ ID NO: 24035 - DNA, 20 bp, Artificial Sequence
  Description of Artificial Sequence: Synthetic oligonucleotide
tttgtggtcttctttgtcac

SEQ ID NO: 24036 - DNA, 20 bp, Artificial Sequence
  Description of Artificial Sequence: Synthetic oligonucleotide
atttgtggtcttctttgtca

SEQ ID NO: 24037 - DNA, 20 bp, Artificial Sequence
  Description of Artificial Sequence: Synthetic oligonucleotide
tatttgtggtcttctttgtc

SEQ ID NO: 24038 - DNA, 20 bp, Artificial Sequence
  Description of Artificial Sequence: Synthetic oligonucleotide
ctatttgtggtcttctttgt

SEQ ID NO: 24039 - DNA, 20 bp, Artificial Sequence
  Description of Artificial Sequence: Synthetic oligonucleotide
actatttgtggtcttctttg

SEQ ID NO: 24040 - DNA, 20 bp, Artificial Sequence
  Description of Artificial Sequence: Synthetic oligonucleotide
aactatttgtggtcttcttt

SEQ ID NO: 24041 - DNA, 20 bp, Artificial Sequence
  Description of Artificial Sequence: Synthetic oligonucleotide
taactatttgtggtcttctt

SEQ ID NO: 24042 - DNA, 20 bp, Artificial Sequence
  Description of Artificial Sequence: Synthetic oligonucleotide
ataactatttgtggtcttct

SEQ ID NO: 24043 - DNA, 20 bp, Artificial Sequence
  Description of Artificial Sequence: Synthetic oligonucleotide
gataactatttgtggtcttc

SEQ ID NO: 24044 - DNA, 20 bp, Artificial Sequence
  Description of Artificial Sequence: Synthetic oligonucleotide
agataactatttgtggtctt

SEQ ID NO: 24045 - DNA, 20 bp, Artificial Sequence
  Description of Artificial Sequence: Synthetic oligonucleotide
aagataactatttgtggtct

SEQ ID NO: 24046 - DNA, 20 bp, Artificial Sequence
  Description of Artificial Sequence: Synthetic oligonucleotide
aaagataactatttgtggtc

SEQ ID NO: 24047 - DNA, 20 bp, Artificial Sequence
  Description of Artificial Sequence: Synthetic oligonucleotide
aaaagataactatttgtggt

SEQ ID NO: 24048 - DNA, 20 bp, Artificial Sequence
  Description of Artificial Sequence: Synthetic oligonucleotide
taaaagataactatttgtgg

SEQ ID NO: 24049 - DNA, 20 bp, Artificial Sequence
  Description of Artificial Sequence: Synthetic oligonucleotide
ttaaaagataactatttgtg

SEQ ID NO: 24050 - DNA, 20 bp, Artificial Sequence
  Description of Artificial Sequence: Synthetic oligonucleotide
attaaaagataactatttgt

SEQ ID NO: 24051 - DNA, 20 bp, Artificial Sequence
  Description of Artificial Sequence: Synthetic oligonucleotide
aattaaaagataactatttg

SEQ ID NO: 24052 - DNA, 20 bp, Artificial Sequence
  Description of Artificial Sequence: Synthetic oligonucleotide
taattaaaagataactattt

SEQ ID NO: 24053 - DNA, 20 bp, Artificial Sequence
  Description of Artificial Sequence: Synthetic oligonucleotide
gtaattaaaagataactatt

SEQ ID NO: 24054 - DNA, 20 bp, Artificial Sequence
  Description of Artificial Sequence: Synthetic oligonucleotide
tgtaattaaaagataactat

SEQ ID NO: 24055 - DNA, 20 bp, Artificial Sequence
  Description of Artificial Sequence: Synthetic oligonucleotide
ctgtaattaaaagataacta

SEQ ID NO: 24056 - DNA, 20 bp, Artificial Sequence
  Description of Artificial Sequence: Synthetic oligonucleotide
tctgtaattaaaagataact

SEQ ID NO: 24057 - DNA, 20 bp, Artificial Sequence
  Description of Artificial Sequence: Synthetic oligonucleotide
ttctgtaattaaaagataac

SEQ ID NO: 24058 - DNA, 20 bp, Artificial Sequence
  Description of Artificial Sequence: Synthetic oligonucleotide
cttctgtaattaaaagataa

SEQ ID NO: 24059 - DNA, 20 bp, Artificial Sequence
  Description of Artificial Sequence: Synthetic oligonucleotide
tcttctgtaattaaaagata

SEQ ID NO: 24060 - DNA, 20 bp, Artificial Sequence
  Description of Artificial Sequence: Synthetic oligonucleotide
ctcttctgtaattaaaagat

SEQ ID NO: 24061 - DNA, 20 bp, Artificial Sequence
  Description of Artificial Sequence: Synthetic oligonucleotide
actcttctgtaattaaaaga

SEQ ID NO: 24062 - DNA, 20 bp, Artificial Sequence
  Description of Artificial Sequence: Synthetic oligonucleotide
aactcttctgtaattaaaag

SEQ ID NO: 24063 - DNA, 20 bp, Artificial Sequence
  Description of Artificial Sequence: Synthetic oligonucleotide
aaactcttctgtaattaaaa

SEQ ID NO: 24064 - DNA, 20 bp, Artificial Sequence
  Description of Artificial Sequence: Synthetic oligonucleotide
gaaactcttctgtaattaaa

SEQ ID NO: 24065 - DNA, 20 bp, Artificial Sequence
  Description of Artificial Sequence: Synthetic oligonucleotide
agaaactcttctgtaattaa

SEQ ID NO: 24066 - DNA, 20 bp, Artificial Sequence
  Description of Artificial Sequence: Synthetic oligonucleotide
aagaaactcttctgtaatta

SEQ ID NO: 24067 - DNA, 20 bp, Artificial Sequence
  Description of Artificial Sequence: Synthetic oligonucleotide
taagaaactcttctgtaatt

SEQ ID NO: 24068 - DNA, 20 bp, Artificial Sequence
  Description of Artificial Sequence: Synthetic oligonucleotide
ttaagaaactcttctgtaat

SEQ ID NO: 24069 - DNA, 20 bp, Artificial Sequence
  Description of Artificial Sequence: Synthetic oligonucleotide
gttaagaaactcttctgtaa

SEQ ID NO: 24070 - DNA, 20 bp, Artificial Sequence
  Description of Artificial Sequence: Synthetic oligonucleotide
agttaagaaactcttctgta

SEQ ID NO: 24071 - DNA, 20 bp, Artificial Sequence
  Description of Artificial Sequence: Synthetic oligonucleotide
aagttaagaaactcttctgt

SEQ ID NO: 24072 - DNA, 20 bp, Artificial Sequence
  Description of Artificial Sequence: Synthetic oligonucleotide
taagttaagaaactcttctg

SEQ ID NO: 24073 - DNA, 20 bp, Artificial Sequence
  Description of Artificial Sequence: Synthetic oligonucleotide
gtaagttaagaaactcttct

SEQ ID NO: 24074 - DNA, 20 bp, Artificial Sequence
  Description of Artificial Sequence: Synthetic oligonucleotide
agtaagttaagaaactcttc

SEQ ID NO: 24075 - DNA, 20 bp, Artificial Sequence
  Description of Artificial Sequence: Synthetic oligonucleotide
aagtaagttaagaaactctt

SEQ ID NO: 24076 - DNA, 20 bp, Artificial Sequence
  Description of Artificial Sequence: Synthetic oligonucleotide
aaagtaagttaagaaactct

SEQ ID NO: 24077 - DNA, 20 bp, Artificial Sequence
  Description of Artificial Sequence: Synthetic oligonucleotide
aaaagtaagttaagaaactc

SEQ ID NO: 24078 - DNA, 20 bp, Artificial Sequence
  Description of Artificial Sequence: Synthetic oligonucleotide
caaaagtaagttaagaaact

SEQ ID NO: 24079 - DNA, 20 bp, Artificial Sequence
  Description of Artificial Sequence: Synthetic oligonucleotide
acaaaagtaagttaagaaac

SEQ ID NO: 24080 - DNA, 20 bp, Artificial Sequence
  Description of Artificial Sequence: Synthetic oligonucleotide
tacaaaagtaagttaagaaa

SEQ ID NO: 24081 - DNA, 20 bp, Artificial Sequence
  Description of Artificial Sequence: Synthetic oligonucleotide
ttacaaaagtaagttaagaa

SEQ ID NO: 24082 - DNA, 20 bp, Artificial Sequence
  Description of Artificial Sequence: Synthetic oligonucleotide
cttacaaaagtaagttaaga

SEQ ID NO: 24083 - DNA, 20 bp, Artificial Sequence
  Description of Artificial Sequence: Synthetic oligonucleotide
acttacaaaagtaagttaag

SEQ ID NO: 24084 - DNA, 20 bp, Artificial Sequence
  Description of Artificial Sequence: Synthetic oligonucleotide
aacttacaaaagtaagttaa

SEQ ID NO: 24085 - DNA, 20 bp, Artificial Sequence
  Description of Artificial Sequence: Synthetic oligonucleotide
aaacttacaaaagtaagtta

SEQ ID NO: 24086 - DNA, 20 bp, Artificial Sequence
  Description of Artificial Sequence: Synthetic oligonucleotide
aaaacttacaaaagtaagtt

SEQ ID NO: 24087 - DNA, 20 bp, Artificial Sequence
  Description of Artificial Sequence: Synthetic oligonucleotide
aaaaacttacaaaagtaagt

SEQ ID NO: 24088 - DNA, 20 bp, Artificial Sequence
  Description of Artificial Sequence: Synthetic oligonucleotide
taaaaacttacaaaagtaag

SEQ ID NO: 24089 - DNA, 20 bp, Artificial Sequence
  Description of Artificial Sequence: Synthetic oligonucleotide
ataaaaacttacaaaagtaa

SEQ ID NO: 24090 - DNA, 20 bp, Artificial Sequence
  Description of Artificial Sequence: Synthetic oligonucleotide
aataaaaacttacaaaagta

SEQ ID NO: 24091 - DNA, 20 bp, Artificial Sequence
  Description of Artificial Sequence: Synthetic oligonucleotide
caataaaaacttacaaaagt

SEQ ID NO: 24092 - DNA, 20 bp, Artificial Sequence
  Description of Artificial Sequence: Synthetic oligonucleotide
acaataaaaacttacaaaag

SEQ ID NO: 24093 - DNA, 20 bp, Artificial Sequence
  Description of Artificial Sequence: Synthetic oligonucleotide
cacaataaaaacttacaaaa

SEQ ID NO: 24094 - DNA, 20 bp, Artificial Sequence
  Description of Artificial Sequence: Synthetic oligonucleotide
acacaataaaaacttacaaa

SEQ ID NO: 24095 - DNA, 20 bp, Artificial Sequence
  Description of Artificial Sequence: Synthetic oligonucleotide
tacacaataaaaacttacaa

SEQ ID NO: 24096 - DNA, 20 bp, Artificial Sequence
  Description of Artificial Sequence: Synthetic oligonucleotide
ttacacaataaaaacttaca

SEQ ID NO: 24097 - DNA, 20 bp, Artificial Sequence
  Description of Artificial Sequence: Synthetic oligonucleotide
cttacacaataaaaacttac

SEQ ID NO: 24098 - DNA, 20 bp, Artificial Sequence
  Description of Artificial Sequence: Synthetic oligonucleotide
acttacacaataaaaactta

SEQ ID NO: 24099 - DNA, 20 bp, Artificial Sequence
  Description of Artificial Sequence: Synthetic oligonucleotide
aacttacacaataaaaactt

SEQ ID NO: 24100 - DNA, 20 bp, Artificial Sequence
  Description of Artificial Sequence: Synthetic oligonucleotide
aaacttacacaataaaaact

SEQ ID NO: 24101 - DNA, 20 bp, Artificial Sequence
  Description of Artificial Sequence: Synthetic oligonucleotide
taaacttacacaataaaaac

SEQ ID NO: 24102 - DNA, 20 bp, Artificial Sequence
  Description of Artificial Sequence: Synthetic oligonucleotide
ataaacttacacaataaaaa

SEQ ID NO: 24103 - DNA, 20 bp, Artificial Sequence
  Description of Artificial Sequence: Synthetic oligonucleotide
tataaacttacacaataaaa

SEQ ID NO: 24104 - DNA, 20 bp, Artificial Sequence
  Description of Artificial Sequence: Synthetic oligonucleotide
ttataaacttacacaataaa

SEQ ID NO: 24105 - DNA, 20 bp, Artificial Sequence
  Description of Artificial Sequence: Synthetic oligonucleotide
attataaacttacacaataa

SEQ ID NO: 24106 - DNA, 20 bp, Artificial Sequence
  Description of Artificial Sequence: Synthetic oligonucleotide
cattataaacttacacaata

SEQ ID NO: 24107 - DNA, 20 bp, Artificial Sequence
  Description of Artificial Sequence: Synthetic oligonucleotide
gcattataaacttacacaat

SEQ ID NO: 24108 - DNA, 20 bp, Artificial Sequence
  Description of Artificial Sequence: Synthetic oligonucleotide
tgcattataaacttacacaa

SEQ ID NO: 24109 - DNA, 20 bp, Artificial Sequence
  Description of Artificial Sequence: Synthetic oligonucleotide
ctgcattataaacttacaca

SEQ ID NO: 24110 - DNA, 20 bp, Artificial Sequence
  Description of Artificial Sequence: Synthetic oligonucleotide
cctgcattataaacttacac

SEQ ID NO: 24111 - DNA, 20 bp, Artificial Sequence
  Description of Artificial Sequence: Synthetic oligonucleotide
ccctgcattataaacttaca

SEQ ID NO: 24112 - DNA, 20 bp, Artificial Sequence
  Description of Artificial Sequence: Synthetic oligonucleotide
cccctgcattataaacttac

SEQ ID NO: 24113 - DNA, 20 bp, Artificial Sequence
  Description of Artificial Sequence: Synthetic oligonucleotide
tcccctgcattataaactta

SEQ ID NO: 24114 - DNA, 20 bp, Artificial Sequence
  Description of Artificial Sequence: Synthetic oligonucleotide
ttcccctgcattataaactt

SEQ ID NO: 24115 - DNA, 20 bp, Artificial Sequence
  Description of Artificial Sequence: Synthetic oligonucleotide
cttcccctgcattataaact

SEQ ID NO: 24116 - DNA, 20 bp, Artificial Sequence
  Description of Artificial Sequence: Synthetic oligonucleotide
acttcccctgcattataaac

SEQ ID NO: 24117 - DNA, 20 bp, Artificial Sequence
  Description of Artificial Sequence: Synthetic oligonucleotide
tacttcccctgcattataaa

SEQ ID NO: 24118 - DNA, 20 bp, Artificial Sequence
  Description of Artificial Sequence: Synthetic oligonucleotide
gtacttcccctgcattataa

SEQ ID NO: 24119 - DNA, 20 bp, Artificial Sequence
  Description of Artificial Sequence: Synthetic oligonucleotide
agtacttcccctgcattata

SEQ ID NO: 24120 - DNA, 20 bp, Artificial Sequence
  Description of Artificial Sequence: Synthetic oligonucleotide
tagtacttcccctgcattat

SEQ ID NO: 24121 - DNA, 20 bp, Artificial Sequence
  Description of Artificial Sequence: Synthetic oligonucleotide
gtagtacttcccctgcatta

SEQ ID NO: 24122 - DNA, 20 bp, Artificial Sequence
  Description of Artificial Sequence: Synthetic oligonucleotide
agtagtacttcccctgcatt

SEQ ID NO: 24123 - DNA, 20 bp, Artificial Sequence
  Description of Artificial Sequence: Synthetic oligonucleotide
gagtagtacttcccctgcat

SEQ ID NO: 24124 - DNA, 20 bp, Artificial Sequence
  Description of Artificial Sequence: Synthetic oligonucleotide
ggagtagtacttcccctgca

SEQ ID NO: 24125 - DNA, 20 bp, Artificial Sequence
  Description of Artificial Sequence: Synthetic oligonucleotide
aggagtagtacttcccctgc

SEQ ID NO: 24126 - DNA, 20 bp, Artificial Sequence
  Description of Artificial Sequence: Synthetic oligonucleotide
gaggagtagtacttcccctg

SEQ ID NO: 24127 - DNA, 20 bp, Artificial Sequence
  Description of Artificial Sequence: Synthetic oligonucleotide
tgaggagtagtacttcccct

SEQ ID NO: 24128 - DNA, 20 bp, Artificial Sequence
  Description of Artificial Sequence: Synthetic oligonucleotide
ttgaggagtagtacttcccc

SEQ ID NO: 24129 - DNA, 20 bp, Artificial Sequence
  Description of Artificial Sequence: Synthetic oligonucleotide
tttgaggagtagtacttccc

SEQ ID NO: 24130 - DNA, 20 bp, Artificial Sequence
  Description of Artificial Sequence: Synthetic oligonucleotide
atttgaggagtagtacttcc

SEQ ID NO: 24131 - DNA, 20 bp, Artificial Sequence
  Description of Artificial Sequence: Synthetic oligonucleotide
catttgaggagtagtacttc

SEQ ID NO: 24132 - DNA, 20 bp, Artificial Sequence
  Description of Artificial Sequence: Synthetic oligonucleotide
acatttgaggagtagtactt

SEQ ID NO: 24133 - DNA, 20 bp, Artificial Sequence
  Description of Artificial Sequence: Synthetic oligonucleotide
aacatttgaggagtagtact

SEQ ID NO: 24134 - DNA, 20 bp, Artificial Sequence
  Description of Artificial Sequence: Synthetic oligonucleotide
caacatttgaggagtagtac

SEQ ID NO: 24135 - DNA, 20 bp, Artificial Sequence
  Description of Artificial Sequence: Synthetic oligonucleotide
tcaacatttgaggagtagta

SEQ ID NO: 24136 - DNA, 20 bp, Artificial Sequence
  Description of Artificial Sequence: Synthetic oligonucleotide
ctcaacatttgaggagtagt

SEQ ID NO: 24137 - DNA, 20 bp, Artificial Sequence
  Description of Artificial Sequence: Synthetic oligonucleotide
cctcaacatttgaggagtag

SEQ ID NO: 24138 - DNA, 20 bp, Artificial Sequence
  Description of Artificial Sequence: Synthetic oligonucleotide
ccctcaacatttgaggagta

SEQ ID NO: 24139 - DNA, 20 bp, Artificial Sequence
  Description of Artificial Sequence: Synthetic oligonucleotide
tccctcaacatttgaggagt

SEQ ID NO: 24140 - DNA, 20 bp, Artificial Sequence
  Description of Artificial Sequence: Synthetic oligonucleotide
ttccctcaacatttgaggag

SEQ ID NO: 24141 - DNA, 20 bp, Artificial Sequence
  Description of Artificial Sequence: Synthetic oligonucleotide
cttccctcaacatttgagga

SEQ ID NO: 24142 - DNA, 20 bp, Artificial Sequence
  Description of Artificial Sequence: Synthetic oligonucleotide
gcttccctcaacatttgagg

SEQ ID NO: 24143 - DNA, 20 bp, Artificial Sequence
  Description of Artificial Sequence: Synthetic oligonucleotide
agcttccctcaacatttgag

SEQ ID NO: 24144 - DNA, 20 bp, Artificial Sequence
  Description of Artificial Sequence: Synthetic oligonucleotide
aagcttccctcaacatttga

SEQ ID NO: 24145 - DNA, 20 bp, Artificial Sequence
  Description of Artificial Sequence: Synthetic oligonucleotide
gaagcttccctcaacatttg

SEQ ID NO: 24146 - DNA, 20 bp, Artificial Sequence
  Description of Artificial Sequence: Synthetic oligonucleotide
ggaagcttccctcaacattt

SEQ ID NO: 24147 - DNA, 20 bp, Artificial Sequence
  Description of Artificial Sequence: Synthetic oligonucleotide
tggaagcttccctcaacatt

SEQ ID NO: 24148 - DNA, 20 bp, Artificial Sequence
  Description of Artificial Sequence: Synthetic oligonucleotide
atggaagcttccctcaacat

SEQ ID NO: 24149 - DNA, 20 bp, Artificial Sequence
  Description of Artificial Sequence: Synthetic oligonucleotide
tatggaagcttccctcaaca

SEQ ID NO: 24150 - DNA, 20 bp, Artificial Sequence
  Description of Artificial Sequence: Synthetic oligonucleotide
ttatggaagcttccctcaac

SEQ ID NO: 24151 - DNA, 20 bp, Artificial Sequence
  Description of Artificial Sequence: Synthetic oligonucleotide
gttatggaagcttccctcaa

SEQ ID NO: 24152 - DNA, 20 bp, Artificial Sequence
  Description of Artificial Sequence: Synthetic oligonucleotide
tgttatggaagcttccctca

SEQ ID NO: 24153 - DNA, 20 bp, Artificial Sequence
  Description of Artificial Sequence: Synthetic oligonucleotide
atgttatggaagcttccctc

SEQ ID NO: 24154 - DNA, 20 bp, Artificial Sequence
  Description of Artificial Sequence: Synthetic oligonucleotide
aatgttatggaagcttccct

SEQ ID NO: 24155 - DNA, 20 bp, Artificial Sequence
  Description of Artificial Sequence: Synthetic oligonucleotide
caatgttatggaagcttccc

SEQ ID NO: 24156 - DNA, 20 bp, Artificial Sequence
  Description of Artificial Sequence: Synthetic oligonucleotide
tcaatgttatggaagcttcc

SEQ ID NO: 24157 - DNA, 20 bp, Artificial Sequence
  Description of Artificial Sequence: Synthetic oligonucleotide
atcaatgttatggaagcttc

SEQ ID NO: 24158 - DNA, 20 bp, Artificial Sequence
  Description of Artificial Sequence: Synthetic oligonucleotide
catcaatgttatggaagctt

SEQ ID NO: 24159 - DNA, 20 bp, Artificial Sequence
  Description of Artificial Sequence: Synthetic oligonucleotide
tcatcaatgttatggaagct

SEQ ID NO: 24160 - DNA, 20 bp, Artificial Sequence
  Description of Artificial Sequence: Synthetic oligonucleotide
gtcatcaatgttatggaagc

SEQ ID NO: 24161 - DNA, 20 bp, Artificial Sequence
  Description of Artificial Sequence: Synthetic oligonucleotide
agtcatcaatgttatggaag

SEQ ID NO: 24162 - DNA, 20 bp, Artificial Sequence
  Description of Artificial Sequence: Synthetic oligonucleotide
cagtcatcaatgttatggaa

SEQ ID NO: 24163 - DNA, 20 bp, Artificial Sequence
  Description of Artificial Sequence: Synthetic oligonucleotide
ccagtcatcaatgttatgga

SEQ ID NO: 24164 - DNA, 20 bp, Artificial Sequence
  Description of Artificial Sequence: Synthetic oligonucleotide
gccagtcatcaatgttatgg

SEQ ID NO: 24165 - DNA, 20 bp, Artificial Sequence
  Description of Artificial Sequence: Synthetic oligonucleotide
agccagtcatcaatgttatg

SEQ ID NO: 24166 - DNA, 20 bp, Artificial Sequence
  Description of Artificial Sequence: Synthetic oligonucleotide
aagccagtcatcaatgttat

SEQ ID NO: 24167 - DNA, 20 bp, Artificial Sequence
  Description of Artificial Sequence: Synthetic oligonucleotide
gaagccagtcatcaatgtta

SEQ ID NO: 24168 - DNA, 20 bp, Artificial Sequence
  Description of Artificial Sequence: Synthetic oligonucleotide
tgaagccagtcatcaatgtt

SEQ ID NO: 24169 - DNA, 20 bp, Artificial Sequence
  Description of Artificial Sequence: Synthetic oligonucleotide
atgaagccagtcatcaatgt

SEQ ID NO: 24170 - DNA, 20 bp, Artificial Sequence
  Description of Artificial Sequence: Synthetic oligonucleotide
catgaagccagtcatcaatg

SEQ ID NO: 24171 - DNA, 20 bp, Artificial Sequence
  Description of Artificial Sequence: Synthetic oligonucleotide
ccatgaagccagtcatcaat

SEQ ID NO: 24172 - DNA, 20 bp, Artificial Sequence
  Description of Artificial Sequence: Synthetic oligonucleotide
gccatgaagccagtcatcaa

SEQ ID NO: 24173 - DNA, 20 bp, Artificial Sequence
  Description of Artificial Sequence: Synthetic oligonucleotide
tgccatgaagccagtcatca

SEQ ID NO: 24174 - DNA, 20 bp, Artificial Sequence
  Description of Artificial Sequence: Synthetic oligonucleotide
ctgccatgaagccagtcatc

SEQ ID NO: 24175 - DNA, 20 bp, Artificial Sequence
  Description of Artificial Sequence: Synthetic oligonucleotide
actgccatgaagccagtcat

SEQ ID NO: 24176 - DNA, 20 bp, Artificial Sequence
  Description of Artificial Sequence: Synthetic oligonucleotide
tactgccatgaagccagtca

SEQ ID NO: 24177 - DNA, 20 bp, Artificial Sequence
  Description of Artificial Sequence: Synthetic oligonucleotide
ttactgccatgaagccagtc

SEQ ID NO: 24178 - DNA, 20 bp, Artificial Sequence
  Description of Artificial Sequence: Synthetic oligonucleotide
attactgccatgaagccagt

SEQ ID NO: 24179 - DNA, 20 bp, Artificial Sequence
  Description of Artificial Sequence: Synthetic oligonucleotide
aattactgccatgaagccag

SEQ ID NO: 24180 - DNA, 20 bp, Artificial Sequence
  Description of Artificial Sequence: Synthetic oligonucleotide
gaattactgccatgaagcca

SEQ ID NO: 24181 - DNA, 20 bp, Artificial Sequence
  Description of Artificial Sequence: Synthetic oligonucleotide
agaattactgccatgaagcc

SEQ ID NO: 24182 - DNA, 20 bp, Artificial Sequence
  Description of Artificial Sequence: Synthetic oligonucleotide
gagaattactgccatgaagc

SEQ ID NO: 24183 - DNA, 20 bp, Artificial Sequence
  Description of Artificial Sequence: Synthetic oligonucleotide
cgagaattactgccatgaag

SEQ ID NO: 24184 - DNA, 20 bp, Artificial Sequence
  Description of Artificial Sequence: Synthetic oligonucleotide
ccgagaattactgccatgaa

SEQ ID NO: 24185 - DNA, 20 bp, Artificial Sequence
  Description of Artificial Sequence: Synthetic oligonucleotide
gccgagaattactgccatga

SEQ ID NO: 24186 - DNA, 20 bp, Artificial Sequence
  Description of Artificial Sequence: Synthetic oligonucleotide
agccgagaattactgccatg

SEQ ID NO: 24187 - DNA, 20 bp, Artificial Sequence
  Description of Artificial Sequence: Synthetic oligonucleotide
cagccgagaattactgccat

SEQ ID NO: 24188 - DNA, 20 bp, Artificial Sequence
  Description of Artificial Sequence: Synthetic oligonucleotide
acagccgagaattactgcca

SEQ ID NO: 24189 - DNA, 20 bp, Artificial Sequence
  Description of Artificial Sequence: Synthetic oligonucleotide
tacagccgagaattactgcc

SEQ ID NO: 24190 - DNA, 20 bp, Artificial Sequence
  Description of Artificial Sequence: Synthetic oligonucleotide
ctacagccgagaattactgc

SEQ ID NO: 24191 - DNA, 20 bp, Artificial Sequence
  Description of Artificial Sequence: Synthetic oligonucleotide
actacagccgagaattactg

SEQ ID NO: 24192 - DNA, 20 bp, Artificial Sequence
  Description of Artificial Sequence: Synthetic oligonucleotide
aactacagccgagaattact

SEQ ID NO: 24193 - DNA, 20 bp, Artificial Sequence
  Description of Artificial Sequence: Synthetic oligonucleotide
caactacagccgagaattac

SEQ ID NO: 24194 - DNA, 20 bp, Artificial Sequence
  Description of Artificial Sequence: Synthetic oligonucleotide
gcaactacagccgagaatta

SEQ ID NO: 24195 - DNA, 20 bp, Artificial Sequence
  Description of Artificial Sequence: Synthetic oligonucleotide
tgcaactacagccgagaatt

SEQ ID NO: 24196 - DNA, 20 bp, Artificial Sequence
  Description of Artificial Sequence: Synthetic oligonucleotide
atgcaactacagccgagaat

SEQ ID NO: 24197 - DNA, 20 bp, Artificial Sequence
  Description of Artificial Sequence: Synthetic oligonucleotide
tatgcaactacagccgagaa

SEQ ID NO: 24198 - DNA, 20 bp, Artificial Sequence
  Description of Artificial Sequence: Synthetic oligonucleotide
ttatgcaactacagccgaga

SEQ ID NO: 24199 - DNA, 20 bp, Artificial Sequence
  Description of Artificial Sequence: Synthetic oligonucleotide
cttatgcaactacagccgag

SEQ ID NO: 24200 - DNA, 20 bp, Artificial Sequence
  Description of Artificial Sequence: Synthetic oligonucleotide
gcttatgcaactacagccga

SEQ ID NO: 24201 - DNA, 20 bp, Artificial Sequence
  Description of Artificial Sequence: Synthetic oligonucleotide
tgcttatgcaactacagccg

SEQ ID NO: 24202 - DNA, 20 bp, Artificial Sequence
  Description of Artificial Sequence: Synthetic oligonucleotide
atgcttatgcaactacagcc

SEQ ID NO: 24203 - DNA, 20 bp, Artificial Sequence
  Description of Artificial Sequence: Synthetic oligonucleotide
aatgcttatgcaactacagc

SEQ ID NO: 24204 - DNA, 20 bp, Artificial Sequence
  Description of Artificial Sequence: Synthetic oligonucleotide
caatgcttatgcaactacag

SEQ ID NO: 24205 - DNA, 20 bp, Artificial Sequence
  Description of Artificial Sequence: Synthetic oligonucleotide
gcaatgcttatgcaactaca

SEQ ID NO: 24206 - DNA, 20 bp, Artificial Sequence
  Description of Artificial Sequence: Synthetic oligonucleotide
agcaatgcttatgcaactac

SEQ ID NO: 24207 - DNA, 20 bp, Artificial Sequence
  Description of Artificial Sequence: Synthetic oligonucleotide
gagcaatgcttatgcaacta

SEQ ID NO: 24208 - DNA, 20 bp, Artificial Sequence
  Description of Artificial Sequence: Synthetic oligonucleotide
tgagcaatgcttatgcaact

SEQ ID NO: 24209 - DNA, 20 bp, Artificial Sequence
  Description of Artificial Sequence: Synthetic oligonucleotide
ttgagcaatgcttatgcaac

SEQ ID NO: 24210 - DNA, 20 bp, Artificial Sequence
  Description of Artificial Sequence: Synthetic oligonucleotide
cttgagcaatgcttatgcaa

SEQ ID NO: 24211 - DNA, 20 bp, Artificial Sequence
  Description of Artificial Sequence: Synthetic oligonucleotide
tcttgagcaatgcttatgca

SEQ ID NO: 24212 - DNA, 20 bp, Artificial Sequence
  Description of Artificial Sequence: Synthetic oligonucleotide
ctcttgagcaatgcttatgc

SEQ ID NO: 24213 - DNA, 20 bp, Artificial Sequence
  Description of Artificial Sequence: Synthetic oligonucleotide
cctcttgagcaatgcttatg

SEQ ID NO: 24214 - DNA, 20 bp, Artificial Sequence
  Description of Artificial Sequence: Synthetic oligonucleotide
tcctcttgagcaatgcttat

SEQ ID NO: 24215 - DNA, 20 bp, Artificial Sequence
  Description of Artificial Sequence: Synthetic oligonucleotide
ttcctcttgagcaatgctta

SEQ ID NO: 24216 - DNA, 20 bp, Artificial Sequence
  Description of Artificial Sequence: Synthetic oligonucleotide
tttcctcttgagcaatgctt

SEQ ID NO: 24217 - DNA, 20 bp, Artificial Sequence
  Description of Artificial Sequence: Synthetic oligonucleotide
ttttcctcttgagcaatgct

SEQ ID NO: 24218 - DNA, 20 bp, Artificial Sequence
  Description of Artificial Sequence: Synthetic oligonucleotide
attttcctcttgagcaatgc

SEQ ID NO: 24219 - DNA, 20 bp, Artificial Sequence
  Description of Artificial Sequence: Synthetic oligonucleotide
gattttcctcttgagcaatg

SEQ ID NO: 24220 - DNA, 20 bp, Artificial Sequence
  Description of Artificial Sequence: Synthetic oligonucleotide
ggattttcctcttgagcaat

SEQ ID NO: 24221 - DNA, 20 bp, Artificial Sequence
  Description of Artificial Sequence: Synthetic oligonucleotide
tggattttcctcttgagcaa

SEQ ID NO: 24222 - DNA, 20 bp, Artificial Sequence
  Description of Artificial Sequence: Synthetic oligonucleotide
ttggattttcctcttgagca

SEQ ID NO: 24223 - DNA, 20 bp, Artificial Sequence
  Description of Artificial Sequence: Synthetic oligonucleotide
tttggattttcctcttgagc

SEQ ID NO: 24224 - DNA, 20 bp, Artificial Sequence
  Description of Artificial Sequence: Synthetic oligonucleotide
ttttggattttcctcttgag

SEQ ID NO: 24225 - DNA, 20 bp, Artificial Sequence
  Description of Artificial Sequence: Synthetic oligonucleotide
cttttggattttcctcttga

SEQ ID NO: 24226 - DNA, 20 bp, Artificial Sequence
  Description of Artificial Sequence: Synthetic oligonucleotide
acttttggattttcctcttg

SEQ ID NO: 24227 - DNA, 20 bp, Artificial Sequence
  Description of Artificial Sequence: Synthetic oligonucleotide
cacttttggattttcctctt

SEQ ID NO: 24228 - DNA, 20 bp, Artificial Sequence
  Description of Artificial Sequence: Synthetic oligonucleotide
gcacttttggattttcctct

SEQ ID NO: 24229 - DNA, 20 bp, Artificial Sequence
  Description of Artificial Sequence: Synthetic oligonucleotide
tgcacttttggattttcctc

SEQ ID NO: 24230 - DNA, 20 bp, Artificial Sequence
  Description of Artificial Sequence: Synthetic oligonucleotide
ctgcacttttggattttcct

SEQ ID NO: 24231 - DNA, 20 bp, Artificial Sequence
  Description of Artificial Sequence: Synthetic oligonucleotide
gctgcacttttggattttcc

SEQ ID NO: 24232 - DNA, 20 bp, Artificial Sequence
  Description of Artificial Sequence: Synthetic oligonucleotide
tgctgcacttttggattttc

SEQ ID NO: 24233 - DNA, 20 bp, Artificial Sequence
  Description of Artificial Sequence: Synthetic oligonucleotide
ctgctgcacttttggatttt

SEQ ID NO: 24234 - DNA, 20 bp, Artificial Sequence
  Description of Artificial Sequence: Synthetic oligonucleotide
cctgctgcacttttggattt

SEQ ID NO: 24235 - DNA, 20 bp, Artificial Sequence
  Description of Artificial Sequence: Synthetic oligonucleotide
tcctgctgcacttttggatt

SEQ ID NO: 24236 - DNA, 20 bp, Artificial Sequence
  Description of Artificial Sequence: Synthetic oligonucleotide
ctcctgctgcacttttggat

SEQ ID NO: 24237 - DNA, 20 bp, Artificial Sequence
  Description of Artificial Sequence: Synthetic oligonucleotide
tctcctgctgcacttttgga

SEQ ID NO: 24238 - DNA, 20 bp, Artificial Sequence
  Description of Artificial Sequence: Synthetic oligonucleotide
ttctcctgctgcacttttgg

SEQ ID NO: 24239 - DNA, 20 bp, Artificial Sequence
  Description of Artificial Sequence: Synthetic oligonucleotide
gttctcctgctgcacttttg

SEQ ID NO: 24240 - DNA, 20 bp, Artificial Sequence
  Description of Artificial Sequence: Synthetic oligonucleotide
agttctcctgctgcactttt

SEQ ID NO: 24241 - DNA, 20 bp, Artificial Sequence
  Description of Artificial Sequence: Synthetic oligonucleotide
gagttctcctgctgcacttt

SEQ ID NO: 24242 - DNA, 20 bp, Artificial Sequence
  Description of Artificial Sequence: Synthetic oligonucleotide
agagttctcctgctgcactt

SEQ ID NO: 24243 - DNA, 20 bp, Artificial Sequence
  Description of Artificial Sequence: Synthetic oligonucleotide
aagagttctcctgctgcact

SEQ ID NO: 24244 - DNA, 20 bp, Artificial Sequence
  Description of Artificial Sequence: Synthetic oligonucleotide
aaagagttctcctgctgcac

SEQ ID NO: 24245 - DNA, 20 bp, Artificial Sequence
  Description of Artificial Sequence: Synthetic oligonucleotide
aaaagagttctcctgctgca

SEQ ID NO: 24246 - DNA, 20 bp, Artificial Sequence
  Description of Artificial Sequence: Synthetic oligonucleotide
gaaaagagttctcctgctgc

SEQ ID NO: 24247 - DNA, 20 bp, Artificial Sequence
  Description of Artificial Sequence: Synthetic oligonucleotide
ggaaaagagttctcctgctg

SEQ ID NO: 24248 - DNA, 20 bp, Artificial Sequence
  Description of Artificial Sequence: Synthetic oligonucleotide
gggaaaagagttctcctgct

SEQ ID NO: 24249 - DNA, 20 bp, Artificial Sequence
  Description of Artificial Sequence: Synthetic oligonucleotide
agggaaaagagttctcctgc

SEQ ID NO: 24250 - DNA, 20 bp, Artificial Sequence
  Description of Artificial Sequence: Synthetic oligonucleotide
cagggaaaagagttctcctg

SEQ ID NO: 24251 - DNA, 20 bp, Artificial Sequence
  Description of Artificial Sequence: Synthetic oligonucleotide
tcagggaaaagagttctcct

SEQ ID NO: 24252 - DNA, 20 bp, Artificial Sequence
  Description of Artificial Sequence: Synthetic oligonucleotide
ttcagggaaaagagttctcc

SEQ ID NO: 24253 - DNA, 20 bp, Artificial Sequence
  Description of Artificial Sequence: Synthetic oligonucleotide
tttcagggaaaagagttctc

SEQ ID NO: 24254 - DNA, 20 bp, Artificial Sequence
  Description of Artificial Sequence: Synthetic oligonucleotide
ttttcagggaaaagagttct

SEQ ID NO: 24255 - DNA, 20 bp, Artificial Sequence
  Description of Artificial Sequence: Synthetic oligonucleotide
tttttcagggaaaagagttc

SEQ ID NO: 24256 - DNA, 20 bp, Artificial Sequence
  Description of Artificial Sequence: Synthetic oligonucleotide
ctttttcagggaaaagagtt

SEQ ID NO: 24257 - DNA, 20 bp, Artificial Sequence
  Description of Artificial Sequence: Synthetic oligonucleotide
cctttttcagggaaaagagt

SEQ ID NO: 24258 - DNA, 20 bp, Artificial Sequence
  Description of Artificial Sequence: Synthetic oligonucleotide
tcctttttcagggaaaagag

SEQ ID NO: 24259 - DNA, 20 bp, Artificial Sequence
  Description of Artificial Sequence: Synthetic oligonucleotide
ttcctttttcagggaaaaga

SEQ ID NO: 24260 - DNA, 20 bp, Artificial Sequence
  Description of Artificial Sequence: Synthetic oligonucleotide
tttcctttttcagggaaaag

SEQ ID NO: 24261 - DNA, 20 bp, Artificial Sequence
  Description of Artificial Sequence: Synthetic oligonucleotide
ttttcctttttcagggaaaa

SEQ ID NO: 24262 - DNA, 20 bp, Artificial Sequence
  Description of Artificial Sequence: Synthetic oligonucleotide
tttttcctttttcagggaaa

SEQ ID NO: 24263 - DNA, 20 bp, Artificial Sequence
  Description of Artificial Sequence: Synthetic oligonucleotide
atttttcctttttcagggaa

SEQ ID NO: 24264 - DNA, 20 bp, Artificial Sequence
  Description of Artificial Sequence: Synthetic oligonucleotide
tatttttcctttttcaggga

SEQ ID NO: 24265 - DNA, 20 bp, Artificial Sequence
  Description of Artificial Sequence: Synthetic oligonucleotide
atatttttcctttttcaggg

SEQ ID NO: 24266 - DNA, 20 bp, Artificial Sequence
  Description of Artificial Sequence: Synthetic oligonucleotide
aatatttttcctttttcagg

SEQ ID NO: 24267 - DNA, 20 bp, Artificial Sequence
  Description of Artificial Sequence: Synthetic oligonucleotide
caatatttttcctttttcag

SEQ ID NO: 24268 - DNA, 20 bp, Artificial Sequence
  Description of Artificial Sequence: Synthetic oligonucleotide
tcaatatttttcctttttca

SEQ ID NO: 24269 - DNA, 20 bp, Artificial Sequence
  Description of Artificial Sequence: Synthetic oligonucleotide
ttcaatatttttcctttttc

SEQ ID NO: 24270 - DNA, 20 bp, Artificial Sequence
  Description of Artificial Sequence: Synthetic oligonucleotide
gttcaatatttttccttttt

SEQ ID NO: 24271 - DNA, 20 bp, Artificial Sequence
  Description of Artificial Sequence: Synthetic oligonucleotide
agttcaatatttttcctttt

SEQ ID NO: 24272 - DNA, 20 bp, Artificial Sequence
  Description of Artificial Sequence: Synthetic oligonucleotide
gagttcaatatttttccttt

SEQ ID NO: 24273 - DNA, 20 bp, Artificial Sequence
  Description of Artificial Sequence: Synthetic oligonucleotide
tgagttcaatatttttcctt

SEQ ID NO: 24274 - DNA, 20 bp, Artificial Sequence
  Description of Artificial Sequence: Synthetic oligonucleotide
ttgagttcaatatttttcct

SEQ ID NO: 24275 - DNA, 20 bp, Artificial Sequence
  Description of Artificial Sequence: Synthetic oligonucleotide
attgagttcaatatttttcc

SEQ ID NO: 24276 - DNA, 20 bp, Artificial Sequence
  Description of Artificial Sequence: Synthetic oligonucleotide
cattgagttcaatatttttc

SEQ ID NO: 24277 - DNA, 20 bp, Artificial Sequence
  Description of Artificial Sequence: Synthetic oligonucleotide
tcattgagttcaatattttt

SEQ ID NO: 24278 - DNA, 20 bp, Artificial Sequence
  Description of Artificial Sequence: Synthetic oligonucleotide
atcattgagttcaatatttt

SEQ ID NO: 24279 - DNA, 20 bp, Artificial Sequence
  Description of Artificial Sequence: Synthetic oligonucleotide
tatcattgagttcaatattt

SEQ ID NO: 24280 - DNA, 20 bp, Artificial Sequence
  Description of Artificial Sequence: Synthetic oligonucleotide
ctatcattgagttcaatatt

SEQ ID NO: 24281 - DNA, 20 bp, Artificial Sequence
  Description of Artificial Sequence: Synthetic oligonucleotide
gctatcattgagttcaatat

SEQ ID NO: 24282 - DNA, 20 bp, Artificial Sequence
  Description of Artificial Sequence: Synthetic oligonucleotide
tgctatcattgagttcaata

SEQ ID NO: 24283 - DNA, 20 bp, Artificial Sequence
  Description of Artificial Sequence: Synthetic oligonucleotide
gtgctatcattgagttcaat

SEQ ID NO: 24284 - DNA, 20 bp, Artificial Sequence
  Description of Artificial Sequence: Synthetic oligonucleotide
ggtgctatcattgagttcaa

SEQ ID NO: 24285 - DNA, 20 bp, Artificial Sequence
  Description of Artificial Sequence: Synthetic oligonucleotide
aggtgctatcattgagttca

SEQ ID NO: 24286 - DNA, 20 bp, Artificial Sequence
  Description of Artificial Sequence: Synthetic oligonucleotide
taggtgctatcattgagttc

SEQ ID NO: 24287 - DNA, 20 bp, Artificial Sequence
  Description of Artificial Sequence: Synthetic oligonucleotide
ttaggtgctatcattgagtt

SEQ ID NO: 24288 - DNA, 20 bp, Artificial Sequence
  Description of Artificial Sequence: Synthetic oligonucleotide
tttaggtgctatcattgagt

SEQ ID NO: 24289 - DNA, 20 bp, Artificial Sequence
  Description of Artificial Sequence: Synthetic oligonucleotide
gtttaggtgctatcattgag

SEQ ID NO: 24290 - DNA, 20 bp, Artificial Sequence
  Description of Artificial Sequence: Synthetic oligonucleotide
agtttaggtgctatcattga

SEQ ID NO: 24291 - DNA, 20 bp, Artificial Sequence
  Description of Artificial Sequence: Synthetic oligonucleotide
aagtttaggtgctatcattg

SEQ ID NO: 24292 - DNA, 20 bp, Artificial Sequence
  Description of Artificial Sequence: Synthetic oligonucleotide
taagtttaggtgctatcatt

SEQ ID NO: 24293 - DNA, 20 bp, Artificial Sequence
  Description of Artificial Sequence: Synthetic oligonucleotide
gtaagtttaggtgctatcat

SEQ ID NO: 24294 - DNA, 20 bp, Artificial Sequence
  Description of Artificial Sequence: Synthetic oligonucleotide
tgtaagtttaggtgctatca

SEQ ID NO: 24295 - DNA, 20 bp, Artificial Sequence
  Description of Artificial Sequence: Synthetic oligonucleotide
atgtaagtttaggtgctatc

SEQ ID NO: 24296 - DNA, 20 bp, Artificial Sequence
  Description of Artificial Sequence: Synthetic oligonucleotide
aatgtaagtttaggtgctat

SEQ ID NO: 24297 - DNA, 20 bp, Artificial Sequence
  Description of Artificial Sequence: Synthetic oligonucleotide
aaatgtaagtttaggtgcta

SEQ ID NO: 24298 - DNA, 20 bp, Artificial Sequence
  Description of Artificial Sequence: Synthetic oligonucleotide
taaatgtaagtttaggtgct

SEQ ID NO: 24299 - DNA, 20 bp, Artificial Sequence
  Description of Artificial Sequence: Synthetic oligonucleotide
ttaaatgtaagtttaggtgc

SEQ ID NO: 24300 - DNA, 20 bp, Artificial Sequence
  Description of Artificial Sequence: Synthetic oligonucleotide
tttaaatgtaagtttaggtg

SEQ ID NO: 24301 - DNA, 20 bp, Artificial Sequence
  Description of Artificial Sequence: Synthetic oligonucleotide
ttttaaatgtaagtttaggt

SEQ ID NO: 24302 - DNA, 20 bp, Artificial Sequence
  Description of Artificial Sequence: Synthetic oligonucleotide
cttttaaatgtaagtttagg

SEQ ID NO: 24303 - DNA, 20 bp, Artificial Sequence
  Description of Artificial Sequence: Synthetic oligonucleotide
tcttttaaatgtaagtttag

SEQ ID NO: 24304 - DNA, 20 bp, Artificial Sequence
  Description of Artificial Sequence: Synthetic oligonucleotide
gtcttttaaatgtaagttta

SEQ ID NO: 24305 - DNA, 20 bp, Artificial Sequence
  Description of Artificial Sequence: Synthetic oligonucleotide
tgtcttttaaatgtaagttt

SEQ ID NO: 24306 - DNA, 20 bp, Artificial Sequence
  Description of Artificial Sequence: Synthetic oligonucleotide
ctgtcttttaaatgtaagtt

SEQ ID NO: 24307 - DNA, 20 bp, Artificial Sequence
  Description of Artificial Sequence: Synthetic oligonucleotide
tctgtcttttaaatgtaagt

SEQ ID NO: 24308 - DNA, 20 bp, Artificial Sequence
  Description of Artificial Sequence: Synthetic oligonucleotide
gtctgtcttttaaatgtaag

SEQ ID NO: 24309 - DNA, 20 bp, Artificial Sequence
  Description of Artificial Sequence: Synthetic oligonucleotide
tgtctgtcttttaaatgtaa

SEQ ID NO: 24310 - DNA, 20 bp, Artificial Sequence
  Description of Artificial Sequence: Synthetic oligonucleotide
atgtctgtcttttaaatgta

SEQ ID NO: 24311 - DNA, 20 bp, Artificial Sequence
  Description of Artificial Sequence: Synthetic oligonucleotide
aatgtctgtcttttaaatgt

SEQ ID NO: 24312 - DNA, 20 bp, Artificial Sequence
  Description of Artificial Sequence: Synthetic oligonucleotide
gaatgtctgtcttttaaatg

SEQ ID NO: 24313 - DNA, 20 bp, Artificial Sequence
  Description of Artificial Sequence: Synthetic oligonucleotide
ggaatgtctgtcttttaaat

SEQ ID NO: 24314 - DNA, 20 bp, Artificial Sequence
  Description of Artificial Sequence: Synthetic oligonucleotide
aggaatgtctgtcttttaaa

SEQ ID NO: 24315 - DNA, 20 bp, Artificial Sequence
  Description of Artificial Sequence: Synthetic oligonucleotide
aaggaatgtctgtcttttaa

SEQ ID NO: 24316 - DNA, 20 bp, Artificial Sequence
  Description of Artificial Sequence: Synthetic oligonucleotide
gaaggaatgtctgtctttta

SEQ ID NO: 24317 - DNA, 20 bp, Artificial Sequence
  Description of Artificial Sequence: Synthetic oligonucleotide
agaaggaatgtctgtctttt

SEQ ID NO: 24318 - DNA, 20 bp, Artificial Sequence
  Description of Artificial Sequence: Synthetic oligonucleotide
tagaaggaatgtctgtcttt

SEQ ID NO: 24319 - DNA, 20 bp, Artificial Sequence
  Description of Artificial Sequence: Synthetic oligonucleotide
gtagaaggaatgtctgtctt

SEQ ID NO: 24320 - DNA, 20 bp, Artificial Sequence
  Description of Artificial Sequence: Synthetic oligonucleotide
tgtagaaggaatgtctgtct

SEQ ID NO: 24321 - DNA, 20 bp, Artificial Sequence
  Description of Artificial Sequence: Synthetic oligonucleotide
atgtagaaggaatgtctgtc

SEQ ID NO: 24322 - DNA, 20 bp, Artificial Sequence
  Description of Artificial Sequence: Synthetic oligonucleotide
catgtagaaggaatgtctgt

SEQ ID NO: 24323 - DNA, 20 bp, Artificial Sequence
  Description of Artificial Sequence: Synthetic oligonucleotide
acatgtagaaggaatgtctg

SEQ ID NO: 24324 - DNA, 20 bp, Artificial Sequence
  Description of Artificial Sequence: Synthetic oligonucleotide
tacatgtagaaggaatgtct

SEQ ID NO: 24325 - DNA, 20 bp, Artificial Sequence
  Description of Artificial Sequence: Synthetic oligonucleotide
ttacatgtagaaggaatgtc

SEQ ID NO: 24326 - DNA, 20 bp, Artificial Sequence
  Description of Artificial Sequence: Synthetic oligonucleotide
attacatgtagaaggaatgt

SEQ ID NO: 24327 - DNA, 20 bp, Artificial Sequence
  Description of Artificial Sequence: Synthetic oligonucleotide
cattacatgtagaaggaatg

SEQ ID NO: 24328 - DNA, 20 bp, Artificial Sequence
  Description of Artificial Sequence: Synthetic oligonucleotide
tcattacatgtagaaggaat

SEQ ID NO: 24329 - DNA, 20 bp, Artificial Sequence
  Description of Artificial Sequence: Synthetic oligonucleotide
gtcattacatgtagaaggaa

SEQ ID NO: 24330 - DNA, 20 bp, Artificial Sequence
  Description of Artificial Sequence: Synthetic oligonucleotide
tgtcattacatgtagaagga

SEQ ID NO: 24331 - DNA, 20 bp, Artificial Sequence
  Description of Artificial Sequence: Synthetic oligonucleotide
gtgtcattacatgtagaagg

SEQ ID NO: 24332 - DNA, 20 bp, Artificial Sequence
  Description of Artificial Sequence: Synthetic oligonucleotide
agtgtcattacatgtagaag

SEQ ID NO: 24333 - DNA, 20 bp, Artificial Sequence
  Description of Artificial Sequence: Synthetic oligonucleotide
aagtgtcattacatgtagaa

SEQ ID NO: 24334 - DNA, 20 bp, Artificial Sequence
  Description of Artificial Sequence: Synthetic oligonucleotide
gaagtgtcattacatgtaga

SEQ ID NO: 24335 - DNA, 20 bp, Artificial Sequence
  Description of Artificial Sequence: Synthetic oligonucleotide
agaagtgtcattacatgtag

SEQ ID NO: 24336 - DNA, 20 bp, Artificial Sequence
  Description of Artificial Sequence: Synthetic oligonucleotide
aagaagtgtcattacatgta

SEQ ID NO: 24337 - DNA, 20 bp, Artificial Sequence
  Description of Artificial Sequence: Synthetic oligonucleotide
caagaagtgtcattacatgt

SEQ ID NO: 24338 - DNA, 20 bp, Artificial Sequence
  Description of Artificial Sequence: Synthetic oligonucleotide
acaagaagtgtcattacatg

SEQ ID NO: 24339 - DNA, 20 bp, Artificial Sequence
  Description of Artificial Sequence: Synthetic oligonucleotide
cacaagaagtgtcattacat

SEQ ID NO: 24340 - DNA, 20 bp, Artificial Sequence
  Description of Artificial Sequence: Synthetic oligonucleotide
acacaagaagtgtcattaca

SEQ ID NO: 24341 - DNA, 20 bp, Artificial Sequence
  Description of Artificial Sequence: Synthetic oligonucleotide
aacacaagaagtgtcattac

SEQ ID NO: 24342 - DNA, 20 bp, Artificial Sequence
  Description of Artificial Sequence: Synthetic oligonucleotide
taacacaagaagtgtcatta

SEQ ID NO: 24343 - DNA, 20 bp, Artificial Sequence
  Description of Artificial Sequence: Synthetic oligonucleotide
ttaacacaagaagtgtcatt

SEQ ID NO: 24344 - DNA, 20 bp, Artificial Sequence
  Description of Artificial Sequence: Synthetic oligonucleotide
tttaacacaagaagtgtcat

SEQ ID NO: 24345 - DNA, 20 bp, Artificial Sequence
  Description of Artificial Sequence: Synthetic oligonucleotide
gtttaacacaagaagtgtca

SEQ ID NO: 24346 - DNA, 20 bp, Artificial Sequence
  Description of Artificial Sequence: Synthetic oligonucleotide
agtttaacacaagaagtgtc

SEQ ID NO: 24347 - DNA, 20 bp, Artificial Sequence
  Description of Artificial Sequence: Synthetic oligonucleotide
tagtttaacacaagaagtgt

SEQ ID NO: 24348 - DNA, 20 bp, Artificial Sequence
  Description of Artificial Sequence: Synthetic oligonucleotide
ttagtttaacacaagaagtg

SEQ ID NO: 24349 - DNA, 20 bp, Artificial Sequence
  Description of Artificial Sequence: Synthetic oligonucleotide
tttagtttaacacaagaagt

SEQ ID NO: 24350 - DNA, 20 bp, Artificial Sequence
  Description of Artificial Sequence: Synthetic oligonucleotide
ttttagtttaacacaagaag

SEQ ID NO: 24351 - DNA, 20 bp, Artificial Sequence
  Description of Artificial Sequence: Synthetic oligonucleotide
tttttagtttaacacaagaa

SEQ ID NO: 24352 - DNA, 20 bp, Artificial Sequence
  Description of Artificial Sequence: Synthetic oligonucleotide
atttttagtttaacacaaga

SEQ ID NO: 24353 - DNA, 20 bp, Artificial Sequence
  Description of Artificial Sequence: Synthetic oligonucleotide
aatttttagtttaacacaag

SEQ ID NO: 24354 - DNA, 20 bp, Artificial Sequence
  Description of Artificial Sequence: Synthetic oligonucleotide
aaatttttagtttaacacaa

SEQ ID NO: 24355 - DNA, 20 bp, Artificial Sequence
  Description of Artificial Sequence: Synthetic oligonucleotide
taaatttttagtttaacaca

SEQ ID NO: 24356 - DNA, 20 bp, Artificial Sequence
  Description of Artificial Sequence: Synthetic oligonucleotide
gtaaatttttagtttaacac

SEQ ID NO: 24357 - DNA, 20 bp, Artificial Sequence
  Description of Artificial Sequence: Synthetic oligonucleotide
tgtaaatttttagtttaaca

SEQ ID NO: 24358 - DNA, 20 bp, Artificial Sequence
  Description of Artificial Sequence: Synthetic oligonucleotide
ttgtaaatttttagtttaac

SEQ ID NO: 24359 - DNA, 20 bp, Artificial Sequence
  Description of Artificial Sequence: Synthetic oligonucleotide
cttgtaaatttttagtttaa

SEQ ID NO: 24360 - DNA, 20 bp, Artificial Sequence
  Description of Artificial Sequence: Synthetic oligonucleotide
tcttgtaaatttttagttta

SEQ ID NO: 24361 - DNA, 20 bp, Artificial Sequence
  Description of Artificial Sequence: Synthetic oligonucleotide
ctcttgtaaatttttagttt

SEQ ID NO: 24362 - DNA, 20 bp, Artificial Sequence
  Description of Artificial Sequence: Synthetic oligonucleotide
tctcttgtaaatttttagtt

SEQ ID NO: 24363 - DNA, 20 bp, Artificial Sequence
  Description of Artificial Sequence: Synthetic oligonucleotide
ttctcttgtaaatttttagt

SEQ ID NO: 24364 - DNA, 20 bp, Artificial Sequence
  Description of Artificial Sequence: Synthetic oligonucleotide
cttctcttgtaaatttttag

SEQ ID NO: 24365 - DNA, 20 bp, Artificial Sequence
  Description of Artificial Sequence: Synthetic oligonucleotide
tcttctcttgtaaattttta

SEQ ID NO: 24366 - DNA, 20 bp, Artificial Sequence
  Description of Artificial Sequence: Synthetic oligonucleotide
ttcttctcttgtaaattttt

SEQ ID NO: 24367 - DNA, 20 bp, Artificial Sequence
  Description of Artificial Sequence: Synthetic oligonucleotide
tttcttctcttgtaaatttt

SEQ ID NO: 24368 - DNA, 20 bp, Artificial Sequence
  Description of Artificial Sequence: Synthetic oligonucleotide
ctttcttctcttgtaaattt

SEQ ID NO: 24369 - DNA, 20 bp, Artificial Sequence
  Description of Artificial Sequence: Synthetic oligonucleotide
actttcttctcttgtaaatt

SEQ ID NO: 24370 - DNA, 20 bp, Artificial Sequence
  Description of Artificial Sequence: Synthetic oligonucleotide
cactttcttctcttgtaaat

SEQ ID NO: 24371 - DNA, 20 bp, Artificial Sequence
  Description of Artificial Sequence: Synthetic oligonucleotide
tcactttcttctcttgtaaa

SEQ ID NO: 24372 - DNA, 20 bp, Artificial Sequence
  Description of Artificial Sequence: Synthetic oligonucleotide
ttcactttcttctcttgtaa

SEQ ID NO: 24373 - DNA, 20 bp, Artificial Sequence
  Description of Artificial Sequence: Synthetic oligonucleotide
tttcactttcttctcttgta

SEQ ID NO: 24374 - DNA, 20 bp, Artificial Sequence
  Description of Artificial Sequence: Synthetic oligonucleotide
ctttcactttcttctcttgt

SEQ ID NO: 24375 - DNA, 20 bp, Artificial Sequence
  Description of Artificial Sequence: Synthetic oligonucleotide
gctttcactttcttctcttg

SEQ ID NO: 24376 - DNA, 20 bp, Artificial Sequence
  Description of Artificial Sequence: Synthetic oligonucleotide
tgctttcactttcttctctt

SEQ ID NO: 24377 - DNA, 20 bp, Artificial Sequence
  Description of Artificial Sequence: Synthetic oligonucleotide
ttgctttcactttcttctct

SEQ ID NO: 24378 - DNA, 20 bp, Artificial Sequence
  Description of Artificial Sequence: Synthetic oligonucleotide
tttgctttcactttcttctc

SEQ ID NO: 24379 - DNA, 20 bp, Artificial Sequence
  Description of Artificial Sequence: Synthetic oligonucleotide
atttgctttcactttcttct

SEQ ID NO: 24380 - DNA, 20 bp, Artificial Sequence
  Description of Artificial Sequence: Synthetic oligonucleotide
catttgctttcactttcttc

SEQ ID NO: 24381 - DNA, 20 bp, Artificial Sequence
  Description of Artificial Sequence: Synthetic oligonucleotide
ccatttgctttcactttctt

SEQ ID NO: 24382 - DNA, 20 bp, Artificial Sequence
  Description of Artificial Sequence: Synthetic oligonucleotide
cccatttgctttcactttct

SEQ ID NO: 24383 - DNA, 20 bp, Artificial Sequence
  Description of Artificial Sequence: Synthetic oligonucleotide
ccccatttgctttcactttc

SEQ ID NO: 24384 - DNA, 20 bp, Artificial Sequence
  Description of Artificial Sequence: Synthetic oligonucleotide
accccatttgctttcacttt

SEQ ID NO: 24385 - DNA, 20 bp, Artificial Sequence
  Description of Artificial Sequence: Synthetic oligonucleotide
aaccccatttgctttcactt

SEQ ID NO: 24386 - DNA, 20 bp, Artificial Sequence
  Description of Artificial Sequence: Synthetic oligonucleotide
aaaccccatttgctttcact

SEQ ID NO: 24387 - DNA, 20 bp, Artificial Sequence
  Description of Artificial Sequence: Synthetic oligonucleotide
gaaaccccatttgctttcac

SEQ ID NO: 24388 - DNA, 20 bp, Artificial Sequence
  Description of Artificial Sequence: Synthetic oligonucleotide
tgaaaccccatttgctttca

SEQ ID NO: 24389 - DNA, 20 bp, Artificial Sequence
  Description of Artificial Sequence: Synthetic oligonucleotide
gtgaaaccccatttgctttc

SEQ ID NO: 24390 - DNA, 20 bp, Artificial Sequence
  Description of Artificial Sequence: Synthetic oligonucleotide
tgtgaaaccccatttgcttt

SEQ ID NO: 24391 - DNA, 20 bp, Artificial Sequence
  Description of Artificial Sequence: Synthetic oligonucleotide
ttgtgaaaccccatttgctt

SEQ ID NO: 24392 - DNA, 20 bp, Artificial Sequence
  Description of Artificial Sequence: Synthetic oligonucleotide
tttgtgaaaccccatttgct

SEQ ID NO: 24393 - DNA, 20 bp, Artificial Sequence
  Description of Artificial Sequence: Synthetic oligonucleotide
atttgtgaaaccccatttgc

SEQ ID NO: 24394 - DNA, 20 bp, Artificial Sequence
  Description of Artificial Sequence: Synthetic oligonucleotide
tatttgtgaaaccccatttg

SEQ ID NO: 24395 - DNA, 20 bp, Artificial Sequence
  Description of Artificial Sequence: Synthetic oligonucleotide
ctatttgtgaaaccccattt

SEQ ID NO: 24396 - DNA, 20 bp, Artificial Sequence
  Description of Artificial Sequence: Synthetic oligonucleotide
actatttgtgaaaccccatt

SEQ ID NO: 24397 - DNA, 20 bp, Artificial Sequence
  Description of Artificial Sequence: Synthetic oligonucleotide
aactatttgtgaaaccccat

SEQ ID NO: 24398 - DNA, 20 bp, Artificial Sequence
  Description of Artificial Sequence: Synthetic oligonucleotide
caactatttgtgaaacccca

SEQ ID NO: 24399 - DNA, 20 bp, Artificial Sequence
  Description of Artificial Sequence: Synthetic oligonucleotide
acaactatttgtgaaacccc

SEQ ID NO: 24400 - DNA, 20 bp, Artificial Sequence
  Description of Artificial Sequence: Synthetic oligonucleotide
tacaactatttgtgaaaccc

SEQ ID NO: 24401 - DNA, 20 bp, Artificial Sequence
  Description of Artificial Sequence: Synthetic oligonucleotide
ttacaactatttgtgaaacc

SEQ ID NO: 24402 - DNA, 20 bp, Artificial Sequence
  Description of Artificial Sequence: Synthetic oligonucleotide
tttacaactatttgtgaaac

SEQ ID NO: 24403 - DNA, 20 bp, Artificial Sequence
  Description of Artificial Sequence: Synthetic oligonucleotide
atttacaactatttgtgaaa

SEQ ID NO: 24404 - DNA, 20 bp, Artificial Sequence
  Description of Artificial Sequence: Synthetic oligonucleotide
tatttacaactatttgtgaa

SEQ ID NO: 24405 - DNA, 20 bp, Artificial Sequence
  Description of Artificial Sequence: Synthetic oligonucleotide
atatttacaactatttgtga

SEQ ID NO: 24406 - DNA, 20 bp, Artificial Sequence
  Description of Artificial Sequence: Synthetic oligonucleotide
tatatttacaactatttgtg

SEQ ID NO: 24407 - DNA, 20 bp, Artificial Sequence
  Description of Artificial Sequence: Synthetic oligonucleotide
ctatatttacaactatttgt

SEQ ID NO: 24408 - DNA, 20 bp, Artificial Sequence
  Description of Artificial Sequence: Synthetic oligonucleotide
actatatttacaactatttg

SEQ ID NO: 24409 - DNA, 20 bp, Artificial Sequence
  Description of Artificial Sequence: Synthetic oligonucleotide
cactatatttacaactattt

SEQ ID NO: 24410 - DNA, 20 bp, Artificial Sequence
  Description of Artificial Sequence: Synthetic oligonucleotide
tcactatatttacaactatt

SEQ ID NO: 24411 - DNA, 20 bp, Artificial Sequence
  Description of Artificial Sequence: Synthetic oligonucleotide
ttcactatatttacaactat

SEQ ID NO: 24412 - DNA, 20 bp, Artificial Sequence
  Description of Artificial Sequence: Synthetic oligonucleotide
cttcactatatttacaacta

SEQ ID NO: 24413 - DNA, 20 bp, Artificial Sequence
  Description of Artificial Sequence: Synthetic oligonucleotide
gcttcactatatttacaact

SEQ ID NO: 24414 - DNA, 20 bp, Artificial Sequence
  Description of Artificial Sequence: Synthetic oligonucleotide
tgcttcactatatttacaac

SEQ ID NO: 24415 - DNA, 20 bp, Artificial Sequence
  Description of Artificial Sequence: Synthetic oligonucleotide
ttgcttcactatatttacaa

SEQ ID NO: 24416 - DNA, 20 bp, Artificial Sequence
  Description of Artificial Sequence: Synthetic oligonucleotide
attgcttcactatatttaca

SEQ ID NO: 24417 - DNA, 20 bp, Artificial Sequence
  Description of Artificial Sequence: Synthetic oligonucleotide
aattgcttcactatatttac

SEQ ID NO: 24418 - DNA, 20 bp, Artificial Sequence
  Description of Artificial Sequence: Synthetic oligonucleotide
aaattgcttcactatattta

SEQ ID NO: 24419 - DNA, 20 bp, Artificial Sequence
  Description of Artificial Sequence: Synthetic oligonucleotide
caaattgcttcactatattt

SEQ ID NO: 24420 - DNA, 20 bp, Artificial Sequence
  Description of Artificial Sequence: Synthetic oligonucleotide
tcaaattgcttcactatatt

SEQ ID NO: 24421 - DNA, 20 bp, Artificial Sequence
  Description of Artificial Sequence: Synthetic oligonucleotide
ttcaaattgcttcactatat

SEQ ID NO: 24422 - DNA, 20 bp, Artificial Sequence
  Description of Artificial Sequence: Synthetic oligonucleotide
tttcaaattgcttcactata

SEQ ID NO: 24423 - DNA, 20 bp, Artificial Sequence
  Description of Artificial Sequence: Synthetic oligonucleotide
atttcaaattgcttcactat

SEQ ID NO: 24424 - DNA, 20 bp, Artificial Sequence
  Description of Artificial Sequence: Synthetic oligonucleotide
tatttcaaattgcttcacta

SEQ ID NO: 24425 - DNA, 20 bp, Artificial Sequence
  Description of Artificial Sequence: Synthetic oligonucleotide
ttatttcaaattgcttcact

SEQ ID NO: 24426 - DNA, 20 bp, Artificial Sequence
  Description of Artificial Sequence: Synthetic oligonucleotide
attatttcaaattgcttcac

SEQ ID NO: 24427 - DNA, 20 bp, Artificial Sequence
  Description of Artificial Sequence: Synthetic oligonucleotide
aattatttcaaattgcttca

SEQ ID NO: 24428 - DNA, 20 bp, Artificial Sequence
  Description of Artificial Sequence: Synthetic oligonucleotide
aaattatttcaaattgcttc

SEQ ID NO: 24429 - DNA, 20 bp, Artificial Sequence
  Description of Artificial Sequence: Synthetic oligonucleotide
aaaattatttcaaattgctt

SEQ ID NO: 24430 - DNA, 20 bp, Artificial Sequence
  Description of Artificial Sequence: Synthetic oligonucleotide
gaaaattatttcaaattgct

SEQ ID NO: 24431 - DNA, 20 bp, Artificial Sequence
  Description of Artificial Sequence: Synthetic oligonucleotide
tgaaaattatttcaaattgc

SEQ ID NO: 24432 - DNA, 20 bp, Artificial Sequence
  Description of Artificial Sequence: Synthetic oligonucleotide
ttgaaaattatttcaaattg

SEQ ID NO: 24433 - DNA, 20 bp, Artificial Sequence
  Description of Artificial Sequence: Synthetic oligonucleotide
cttgaaaattatttcaaatt

SEQ ID NO: 24434 - DNA, 20 bp, Artificial Sequence
  Description of Artificial Sequence: Synthetic oligonucleotide
gcttgaaaattatttcaaat

SEQ ID NO: 24435 - DNA, 20 bp, Artificial Sequence
  Description of Artificial Sequence: Synthetic oligonucleotide
tgcttgaaaattatttcaaa

SEQ ID NO: 24436 - DNA, 20 bp, Artificial Sequence
  Description of Artificial Sequence: Synthetic oligonucleotide
ttgcttgaaaattatttcaa

SEQ ID NO: 24437 - DNA, 20 bp, Artificial Sequence
  Description of Artificial Sequence: Synthetic oligonucleotide
tttgcttgaaaattatttca

SEQ ID NO: 24438 - DNA, 20 bp, Artificial Sequence
  Description of Artificial Sequence: Synthetic oligonucleotide
ctttgcttgaaaattatttc

SEQ ID NO: 24439 - DNA, 20 bp, Artificial Sequence
  Description of Artificial Sequence: Synthetic oligonucleotide
actttgcttgaaaattattt

SEQ ID NO: 24440 - DNA, 20 bp, Artificial Sequence
  Description of Artificial Sequence: Synthetic oligonucleotide
tactttgcttgaaaattatt

SEQ ID NO: 24441 - DNA, 20 bp, Artificial Sequence
  Description of Artificial Sequence: Synthetic oligonucleotide
atactttgcttgaaaattat

SEQ ID NO: 24442 - DNA, 20 bp, Artificial Sequence
  Description of Artificial Sequence: Synthetic oligonucleotide
aatactttgcttgaaaatta

SEQ ID NO: 24443 - DNA, 20 bp, Artificial Sequence
  Description of Artificial Sequence: Synthetic oligonucleotide
caatactttgcttgaaaatt

SEQ ID NO: 24444 - DNA, 20 bp, Artificial Sequence
  Description of Artificial Sequence: Synthetic oligonucleotide
acaatactttgcttgaaaat

SEQ ID NO: 24445 - DNA, 20 bp, Artificial Sequence
  Description of Artificial Sequence: Synthetic oligonucleotide
cacaatactttgcttgaaaa

SEQ ID NO: 24446 - DNA, 20 bp, Artificial Sequence
  Description of Artificial Sequence: Synthetic oligonucleotide
tcacaatactttgcttgaaa

SEQ ID NO: 24447 - DNA, 20 bp, Artificial Sequence
  Description of Artificial Sequence: Synthetic oligonucleotide
ttcacaatactttgcttgaa

SEQ ID NO: 24448 - DNA, 20 bp, Artificial Sequence
  Description of Artificial Sequence: Synthetic oligonucleotide
tttcacaatactttgcttga

SEQ ID NO: 24449 - DNA, 20 bp, Artificial Sequence
  Description of Artificial Sequence: Synthetic oligonucleotide
ctttcacaatactttgcttg

SEQ ID NO: 24450 - DNA, 20 bp, Artificial Sequence
  Description of Artificial Sequence: Synthetic oligonucleotide
actttcacaatactttgctt

SEQ ID NO: 24451 - DNA, 20 bp, Artificial Sequence
  Description of Artificial Sequence: Synthetic oligonucleotide
tactttcacaatactttgct

SEQ ID NO: 24452 - DNA, 20 bp, Artificial Sequence
  Description of Artificial Sequence: Synthetic oligonucleotide
atactttcacaatactttgc

SEQ ID NO: 24453 - DNA, 20 bp, Artificial Sequence
  Description of Artificial Sequence: Synthetic oligonucleotide
aatactttcacaatactttg

SEQ ID NO: 24454 - DNA, 20 bp, Artificial Sequence
  Description of Artificial Sequence: Synthetic oligonucleotide
gaatactttcacaatacttt

SEQ ID NO: 24455 - DNA, 20 bp, Artificial Sequence
  Description of Artificial Sequence: Synthetic oligonucleotide
agaatactttcacaatactt

SEQ ID NO: 24456 - DNA, 20 bp, Artificial Sequence
  Description of Artificial Sequence: Synthetic oligonucleotide
tagaatactttcacaatact

SEQ ID NO: 24457 - DNA, 20 bp, Artificial Sequence
  Description of Artificial Sequence: Synthetic oligonucleotide
ttagaatactttcacaatac

SEQ ID NO: 24458 - DNA, 20 bp, Artificial Sequence
  Description of Artificial Sequence: Synthetic oligonucleotide
cttagaatactttcacaata

SEQ ID NO: 24459 - DNA, 20 bp, Artificial Sequence
  Description of Artificial Sequence: Synthetic oligonucleotide
gcttagaatactttcacaat

SEQ ID NO: 24460 - DNA, 20 bp, Artificial Sequence
  Description of Artificial Sequence: Synthetic oligonucleotide
ggcttagaatactttcacaa

SEQ ID NO: 24461 - DNA, 20 bp, Artificial Sequence
  Description of Artificial Sequence: Synthetic oligonucleotide
tggcttagaatactttcaca

SEQ ID NO: 24462 - DNA, 20 bp, Artificial Sequence
  Description of Artificial Sequence: Synthetic oligonucleotide
ttggcttagaatactttcac

SEQ ID NO: 24463 - DNA, 20 bp, Artificial Sequence
  Description of Artificial Sequence: Synthetic oligonucleotide
cttggcttagaatactttca

SEQ ID NO: 24464 - DNA, 20 bp, Artificial Sequence
  Description of Artificial Sequence: Synthetic oligonucleotide
acttggcttagaatactttc

SEQ ID NO: 24465 - DNA, 20 bp, Artificial Sequence
  Description of Artificial Sequence: Synthetic oligonucleotide
aacttggcttagaatacttt

SEQ ID NO: 24466 - DNA, 20 bp, Artificial Sequence
  Description of Artificial Sequence: Synthetic oligonucleotide
aaacttggcttagaatactt

SEQ ID NO: 24467 - DNA, 20 bp, Artificial Sequence
  Description of Artificial Sequence: Synthetic oligonucleotide
aaaacttggcttagaatact

SEQ ID NO: 24468 - DNA, 20 bp, Artificial Sequence
  Description of Artificial Sequence: Synthetic oligonucleotide
taaaacttggcttagaatac

SEQ ID NO: 24469 - DNA, 20 bp, Artificial Sequence
  Description of Artificial Sequence: Synthetic oligonucleotide
ttaaaacttggcttagaata

SEQ ID NO: 24470 - DNA, 20 bp, Artificial Sequence
  Description of Artificial Sequence: Synthetic oligonucleotide
tttaaaacttggcttagaat

SEQ ID NO: 24471 - DNA, 20 bp, Artificial Sequence
  Description of Artificial Sequence: Synthetic oligonucleotide
atttaaaacttggcttagaa

SEQ ID NO: 24472 - DNA, 20 bp, Artificial Sequence
  Description of Artificial Sequence: Synthetic oligonucleotide
tatttaaaacttggcttaga

SEQ ID NO: 24473 - DNA, 20 bp, Artificial Sequence
  Description of Artificial Sequence: Synthetic oligonucleotide
atatttaaaacttggcttag

SEQ ID NO: 24474 - DNA, 20 bp, Artificial Sequence
  Description of Artificial Sequence: Synthetic oligonucleotide
aatatttaaaacttggctta

SEQ ID NO: 24475 - DNA, 20 bp, Artificial Sequence
  Description of Artificial Sequence: Synthetic oligonucleotide
taatatttaaaacttggctt

SEQ ID NO: 24476 - DNA, 20 bp, Artificial Sequence
  Description of Artificial Sequence: Synthetic oligonucleotide
ataatatttaaaacttggct

SEQ ID NO: 24477 - DNA, 20 bp, Artificial Sequence
  Description of Artificial Sequence: Synthetic oligonucleotide
gataatatttaaaacttggc

SEQ ID NO: 24478 - DNA, 20 bp, Artificial Sequence
  Description of Artificial Sequence: Synthetic oligonucleotide
agataatatttaaaacttgg

SEQ ID NO: 24479 - DNA, 20 bp, Artificial Sequence
  Description of Artificial Sequence: Synthetic oligonucleotide
tagataatatttaaaacttg

SEQ ID NO: 24480 - DNA, 20 bp, Artificial Sequence
  Description of Artificial Sequence: Synthetic oligonucleotide
ttagataatatttaaaactt

SEQ ID NO: 24481 - DNA, 20 bp, Artificial Sequence
  Description of Artificial Sequence: Synthetic oligonucleotide
gttagataatatttaaaact

SEQ ID NO: 24482 - DNA, 20 bp, Artificial Sequence
  Description of Artificial Sequence: Synthetic oligonucleotide
tgttagataatatttaaaac

SEQ ID NO: 24483 - DNA, 20 bp, Artificial Sequence
  Description of Artificial Sequence: Synthetic oligonucleotide
ctgttagataatatttaaaa

SEQ ID NO: 24484 - DNA, 20 bp, Artificial Sequence
  Description of Artificial Sequence: Synthetic oligonucleotide
tctgttagataatatttaaa

SEQ ID NO: 24485 - DNA, 20 bp, Artificial Sequence
  Description of Artificial Sequence: Synthetic oligonucleotide
gtctgttagataatatttaa

SEQ ID NO: 24486 - DNA, 20 bp, Artificial Sequence
  Description of Artificial Sequence: Synthetic oligonucleotide
tgtctgttagataatattta

SEQ ID NO: 24487 - DNA, 20 bp, Artificial Sequence
  Description of Artificial Sequence: Synthetic oligonucleotide
ttgtctgttagataatattt

SEQ ID NO: 24488 - DNA, 20 bp, Artificial Sequence
  Description of Artificial Sequence: Synthetic oligonucleotide
cttgtctgttagataatatt

SEQ ID NO: 24489 - DNA, 20 bp, Artificial Sequence
  Description of Artificial Sequence: Synthetic oligonucleotide
tcttgtctgttagataatat

SEQ ID NO: 24490 - DNA, 20 bp, Artificial Sequence
  Description of Artificial Sequence: Synthetic oligonucleotide
ctcttgtctgttagataata

SEQ ID NO: 24491 - DNA, 20 bp, Artificial Sequence
  Description of Artificial Sequence: Synthetic oligonucleotide
actcttgtctgttagataat

SEQ ID NO: 24492 - DNA, 20 bp, Artificial Sequence
  Description of Artificial Sequence: Synthetic oligonucleotide
cactcttgtctgttagataa

SEQ ID NO: 24493 - DNA, 20 bp, Artificial Sequence
  Description of Artificial Sequence: Synthetic oligonucleotide
ccactcttgtctgttagata

SEQ ID NO: 24494 - DNA, 20 bp, Artificial Sequence
  Description of Artificial Sequence: Synthetic oligonucleotide
accactcttgtctgttagat

SEQ ID NO: 24495 - DNA, 20 bp, Artificial Sequence
  Description of Artificial Sequence: Synthetic oligonucleotide
taccactcttgtctgttaga

SEQ ID NO: 24496 - DNA, 20 bp, Artificial Sequence
  Description of Artificial Sequence: Synthetic oligonucleotide
ataccactcttgtctgttag

SEQ ID NO: 24497 - DNA, 20 bp, Artificial Sequence
  Description of Artificial Sequence: Synthetic oligonucleotide
tataccactcttgtctgtta

SEQ ID NO: 24498 - DNA, 20 bp, Artificial Sequence
  Description of Artificial Sequence: Synthetic oligonucleotide
atataccactcttgtctgtt

SEQ ID NO: 24499 - DNA, 20 bp, Artificial Sequence
  Description of Artificial Sequence: Synthetic oligonucleotide
tatataccactcttgtctgt

SEQ ID NO: 24500 - DNA, 20 bp, Artificial Sequence
  Description of Artificial Sequence: Synthetic oligonucleotide
gtatataccactcttgtctg

SEQ ID NO: 24501 - DNA, 20 bp, Artificial Sequence
  Description of Artificial Sequence: Synthetic oligonucleotide
tgtatataccactcttgtct

SEQ ID NO: 24502 - DNA, 20 bp, Artificial Sequence
  Description of Artificial Sequence: Synthetic oligonucleotide
ttgtatataccactcttgtc

SEQ ID NO: 24503 - DNA, 20 bp, Artificial Sequence
  Description of Artificial Sequence: Synthetic oligonucleotide
cttgtatataccactcttgt

SEQ ID NO: 24504 - DNA, 20 bp, Artificial Sequence
  Description of Artificial Sequence: Synthetic oligonucleotide
acttgtatataccactcttg

SEQ ID NO: 24505 - DNA, 20 bp, Artificial Sequence
  Description of Artificial Sequence: Synthetic oligonucleotide
tacttgtatataccactctt

SEQ ID NO: 24506 - DNA, 20 bp, Artificial Sequence
  Description of Artificial Sequence: Synthetic oligonucleotide
ctacttgtatataccactct

SEQ ID NO: 24507 - DNA, 20 bp, Artificial Sequence
  Description of Artificial Sequence: Synthetic oligonucleotide
tctacttgtatataccactc

SEQ ID NO: 24508 - DNA, 20 bp, Artificial Sequence
  Description of Artificial Sequence: Synthetic oligonucleotide
atctacttgtatataccact

SEQ ID NO: 24509 - DNA, 20 bp, Artificial Sequence
  Description of Artificial Sequence: Synthetic oligonucleotide
gatctacttgtatataccac

SEQ ID NO: 24510 - DNA, 20 bp, Artificial Sequence
  Description of Artificial Sequence: Synthetic oligonucleotide
ggatctacttgtatatacca

SEQ ID NO: 24511 - DNA, 20 bp, Artificial Sequence
  Description of Artificial Sequence: Synthetic oligonucleotide
aggatctacttgtatatacc

SEQ ID NO: 24512 - DNA, 20 bp, Artificial Sequence
  Description of Artificial Sequence: Synthetic oligonucleotide
caggatctacttgtatatac

SEQ ID NO: 24513 - DNA, 20 bp, Artificial Sequence
  Description of Artificial Sequence: Synthetic oligonucleotide
tcaggatctacttgtatata

SEQ ID NO: 24514 - DNA, 20 bp, Artificial Sequence
  Description of Artificial Sequence: Synthetic oligonucleotide
ctcaggatctacttgtatat

SEQ ID NO: 24515 - DNA, 20 bp, Artificial Sequence
  Description of Artificial Sequence: Synthetic oligonucleotide
tctcaggatctacttgtata

SEQ ID NO: 24516 - DNA, 20 bp, Artificial Sequence
  Description of Artificial Sequence: Synthetic oligonucleotide
ttctcaggatctacttgtat

SEQ ID NO: 24517 - DNA, 20 bp, Artificial Sequence
  Description of Artificial Sequence: Synthetic oligonucleotide
cttctcaggatctacttgta

SEQ ID NO: 24518 - DNA, 20 bp, Artificial Sequence
  Description of Artificial Sequence: Synthetic oligonucleotide
acttctcaggatctacttgt

SEQ ID NO: 24519 - DNA, 20 bp, Artificial Sequence
  Description of Artificial Sequence: Synthetic oligonucleotide
tacttctcaggatctacttg

SEQ ID NO: 24520 - DNA, 20 bp, Artificial Sequence
  Description of Artificial Sequence: Synthetic oligonucleotide
gtacttctcaggatctactt

SEQ ID NO: 24521 - DNA, 20 bp, Artificial Sequence
  Description of Artificial Sequence: Synthetic oligonucleotide
ggtacttctcaggatctact

SEQ ID NO: 24522 - DNA, 20 bp, Artificial Sequence
  Description of Artificial Sequence: Synthetic oligonucleotide
aggtacttctcaggatctac

SEQ ID NO: 24523 - DNA, 20 bp, Artificial Sequence
  Description of Artificial Sequence: Synthetic oligonucleotide
aaggtacttctcaggatcta

SEQ ID NO: 24524 - DNA, 20 bp, Artificial Sequence
  Description of Artificial Sequence: Synthetic oligonucleotide
aaaggtacttctcaggatct

SEQ ID NO: 24525 - DNA, 20 bp, Artificial Sequence
  Description of Artificial Sequence: Synthetic oligonucleotide
caaaggtacttctcaggatc

SEQ ID NO: 24526 - DNA, 20 bp, Artificial Sequence
  Description of Artificial Sequence: Synthetic oligonucleotide
acaaaggtacttctcaggat

SEQ ID NO: 24527 - DNA, 20 bp, Artificial Sequence
  Description of Artificial Sequence: Synthetic oligonucleotide
aacaaaggtacttctcagga

SEQ ID NO: 24528 - DNA, 20 bp, Artificial Sequence
  Description of Artificial Sequence: Synthetic oligonucleotide
taacaaaggtacttctcagg

SEQ ID NO: 24529 - DNA, 20 bp, Artificial Sequence
  Description of Artificial Sequence: Synthetic oligonucleotide
gtaacaaaggtacttctcag

SEQ ID NO: 24530 - DNA, 20 bp, Artificial Sequence
  Description of Artificial Sequence: Synthetic oligonucleotide
tgtaacaaaggtacttctca

SEQ ID NO: 24531 - DNA, 20 bp, Artificial Sequence
  Description of Artificial Sequence: Synthetic oligonucleotide
ctgtaacaaaggtacttctc

SEQ ID NO: 24532 - DNA, 20 bp, Artificial Sequence
  Description of Artificial Sequence: Synthetic oligonucleotide
gctgtaacaaaggtacttct

SEQ ID NO: 24533 - DNA, 20 bp, Artificial Sequence
  Description of Artificial Sequence: Synthetic oligonucleotide
agctgtaacaaaggtacttc

SEQ ID NO: 24534 - DNA, 20 bp, Artificial Sequence
  Description of Artificial Sequence: Synthetic oligonucleotide
tagctgtaacaaaggtactt

SEQ ID NO: 24535 - DNA, 20 bp, Artificial Sequence
  Description of Artificial Sequence: Synthetic oligonucleotide
gtagctgtaacaaaggtact

SEQ ID NO: 24536 - DNA, 20 bp, Artificial Sequence
  Description of Artificial Sequence: Synthetic oligonucleotide
agtagctgtaacaaaggtac

SEQ ID NO: 24537 - DNA, 20 bp, Artificial Sequence
  Description of Artificial Sequence: Synthetic oligonucleotide
tagtagctgtaacaaaggta

SEQ ID NO: 24538 - DNA, 20 bp, Artificial Sequence
  Description of Artificial Sequence: Synthetic oligonucleotide
atagtagctgtaacaaaggt

SEQ ID NO: 24539 - DNA, 20 bp, Artificial Sequence
  Description of Artificial Sequence: Synthetic oligonucleotide
tatagtagctgtaacaaagg

SEQ ID NO: 24540 - DNA, 20 bp, Artificial Sequence
  Description of Artificial Sequence: Synthetic oligonucleotide
ttatagtagctgtaacaaag

SEQ ID NO: 24541 - DNA, 20 bp, Artificial Sequence
  Description of Artificial Sequence: Synthetic oligonucleotide
tttatagtagctgtaacaaa

SEQ ID NO: 24542 - DNA, 20 bp, Artificial Sequence
  Description of Artificial Sequence: Synthetic oligonucleotide
atttatagtagctgtaacaa

SEQ ID NO: 24543 - DNA, 20 bp, Artificial Sequence
  Description of Artificial Sequence: Synthetic oligonucleotide
tatttatagtagctgtaaca

SEQ ID NO: 24544 - DNA, 20 bp, Artificial Sequence
  Description of Artificial Sequence: Synthetic oligonucleotide
atatttatagtagctgtaac

SEQ ID NO: 24545 - DNA, 20 bp, Artificial Sequence
  Description of Artificial Sequence: Synthetic oligonucleotide
tatatttatagtagctgtaa

SEQ ID NO: 24546 - DNA, 20 bp, Artificial Sequence
  Description of Artificial Sequence: Synthetic oligonucleotide
gtatatttatagtagctgta

SEQ ID NO: 24547 - DNA, 20 bp, Artificial Sequence
  Description of Artificial Sequence: Synthetic oligonucleotide
tgtatatttatagtagctgt

SEQ ID NO: 24548 - DNA, 20 bp, Artificial Sequence
  Description of Artificial Sequence: Synthetic oligonucleotide
atgtatatttatagtagctg

SEQ ID NO: 24549 - DNA, 20 bp, Artificial Sequence
  Description of Artificial Sequence: Synthetic oligonucleotide
tatgtatatttatagtagct

SEQ ID NO: 24550 - DNA, 20 bp, Artificial Sequence
  Description of Artificial Sequence: Synthetic oligonucleotide
atatgtatatttatagtagc

SEQ ID NO: 24551 - DNA, 20 bp, Artificial Sequence
  Description of Artificial Sequence: Synthetic oligonucleotide
tatatgtatatttatagtag

SEQ ID NO: 24552 - DNA, 20 bp, Artificial Sequence
  Description of Artificial Sequence: Synthetic oligonucleotide
ttatatgtatatttatagta

SEQ ID NO: 24553 - DNA, 20 bp, Artificial Sequence
  Description of Artificial Sequence: Synthetic oligonucleotide
tttatatgtatatttatagt

SEQ ID NO: 24554 - DNA, 20 bp, Artificial Sequence
  Description of Artificial Sequence: Synthetic oligonucleotide
atttatatgtatatttatag

SEQ ID NO: 24555 - DNA, 20 bp, Artificial Sequence
  Description of Artificial Sequence: Synthetic oligonucleotide
aatttatatgtatatttata

SEQ ID NO: 24556 - DNA, 20 bp, Artificial Sequence
  Description of Artificial Sequence: Synthetic oligonucleotide
taatttatatgtatatttat

SEQ ID NO: 24557 - DNA, 20 bp, Artificial Sequence
  Description of Artificial Sequence: Synthetic oligonucleotide
ataatttatatgtatattta

SEQ ID NO: 24558 - DNA, 20 bp, Artificial Sequence
  Description of Artificial Sequence: Synthetic oligonucleotide
tataatttatatgtatattt

SEQ ID NO: 24559 - DNA, 20 bp, Artificial Sequence
  Description of Artificial Sequence: Synthetic oligonucleotide
ctataatttatatgtatatt

SEQ ID NO: 24560 - DNA, 20 bp, Artificial Sequence
  Description of Artificial Sequence: Synthetic oligonucleotide
tctataatttatatgtatat

SEQ ID NO: 24561 - DNA, 20 bp, Artificial Sequence
  Description of Artificial Sequence: Synthetic oligonucleotide
ttctataatttatatgtata

SEQ ID NO: 24562 - DNA, 20 bp, Artificial Sequence
  Description of Artificial Sequence: Synthetic oligonucleotide
attctataatttatatgtat

SEQ ID NO: 24563 - DNA, 20 bp, Artificial Sequence
  Description of Artificial Sequence: Synthetic oligonucleotide
gattctataatttatatgta

SEQ ID NO: 24564 - DNA, 20 bp, Artificial Sequence
  Description of Artificial Sequence: Synthetic oligonucleotide
agattctataatttatatgt

SEQ ID NO: 24565 - DNA, 20 bp, Artificial Sequence
  Description of Artificial Sequence: Synthetic oligonucleotide
tagattctataatttatatg

SEQ ID NO: 24566 - DNA, 20 bp, Artificial Sequence
  Description of Artificial Sequence: Synthetic oligonucleotide
gtagattctataatttatat

SEQ ID NO: 24567 - DNA, 20 bp, Artificial Sequence
  Description of Artificial Sequence: Synthetic oligonucleotide
agtagattctataatttata

SEQ ID NO: 24568 - DNA, 20 bp, Artificial Sequence
  Description of Artificial Sequence: Synthetic oligonucleotide
aagtagattctataatttat

SEQ ID NO: 24569 - DNA, 20 bp, Artificial Sequence
  Description of Artificial Sequence: Synthetic oligonucleotide
aaagtagattctataattta

SEQ ID NO: 24570 - DNA, 20 bp, Artificial Sequence
  Description of Artificial Sequence: Synthetic oligonucleotide
taaagtagattctataattt

SEQ ID NO: 24571 - DNA, 20 bp, Artificial Sequence
  Description of Artificial Sequence: Synthetic oligonucleotide
ttaaagtagattctataatt

SEQ ID NO: 24572 - DNA, 20 bp, Artificial Sequence
  Description of Artificial Sequence: Synthetic oligonucleotide
attaaagtagattctataat

SEQ ID NO: 24573 - DNA, 20 bp, Artificial Sequence
  Description of Artificial Sequence: Synthetic oligonucleotide
aattaaagtagattctataa

SEQ ID NO: 24574 - DNA, 20 bp, Artificial Sequence
  Description of Artificial Sequence: Synthetic oligonucleotide
aaattaaagtagattctata

SEQ ID NO: 24575 - DNA, 20 bp, Artificial Sequence
  Description of Artificial Sequence: Synthetic oligonucleotide
taaattaaagtagattctat

SEQ ID NO: 24576 - DNA, 20 bp, Artificial Sequence
  Description of Artificial Sequence: Synthetic oligonucleotide
ataaattaaagtagattcta

SEQ ID NO: 24577 - DNA, 20 bp, Artificial Sequence
  Description of Artificial Sequence: Synthetic oligonucleotide
aataaattaaagtagattct

SEQ ID NO: 24578 - DNA, 20 bp, Artificial Sequence
  Description of Artificial Sequence: Synthetic oligonucleotide
aaataaattaaagtagattc

SEQ ID NO: 24579 - DNA, 20 bp, Artificial Sequence
  Description of Artificial Sequence: Synthetic oligonucleotide
aaaataaattaaagtagatt

SEQ ID NO: 24580 - DNA, 20 bp, Artificial Sequence
  Description of Artificial Sequence: Synthetic oligonucleotide
caaaataaattaaagtagat

SEQ ID NO: 24581 - DNA, 20 bp, Artificial Sequence
  Description of Artificial Sequence: Synthetic oligonucleotide
acaaaataaattaaagtaga

SEQ ID NO: 24582 - DNA, 20 bp, Artificial Sequence
  Description of Artificial Sequence: Synthetic oligonucleotide
cacaaaataaattaaagtag

SEQ ID NO: 24583 - DNA, 20 bp, Artificial Sequence
  Description of Artificial Sequence: Synthetic oligonucleotide
tcacaaaataaattaaagta

SEQ ID NO: 24584 - DNA, 20 bp, Artificial Sequence
  Description of Artificial Sequence: Synthetic oligonucleotide
ttcacaaaataaattaaagt

SEQ ID NO: 24585 - DNA, 20 bp, Artificial Sequence
  Description of Artificial Sequence: Synthetic oligonucleotide
gttcacaaaataaattaaag

SEQ ID NO: 24586 - DNA, 20 bp, Artificial Sequence
  Description of Artificial Sequence: Synthetic oligonucleotide
tgttcacaaaataaattaaa

SEQ ID NO: 24587 - DNA, 20 bp, Artificial Sequence
  Description of Artificial Sequence: Synthetic oligonucleotide
gtgttcacaaaataaattaa

SEQ ID NO: 24588 - DNA, 20 bp, Artificial Sequence
  Description of Artificial Sequence: Synthetic oligonucleotide
agtgttcacaaaataaatta

SEQ ID NO: 24589 - DNA, 20 bp, Artificial Sequence
  Description of Artificial Sequence: Synthetic oligonucleotide
aagtgttcacaaaataaatt

SEQ ID NO: 24590 - DNA, 20 bp, Artificial Sequence
  Description of Artificial Sequence: Synthetic oligonucleotide
aaagtgttcacaaaataaat

SEQ ID NO: 24591 - DNA, 20 bp, Artificial Sequence
  Description of Artificial Sequence: Synthetic oligonucleotide
aaaagtgttcacaaaataaa

SEQ ID NO: 24592 - DNA, 20 bp, Artificial Sequence
  Description of Artificial Sequence: Synthetic oligonucleotide
caaaagtgttcacaaaataa

SEQ ID NO: 24593 - DNA, 20 bp, Artificial Sequence
  Description of Artificial Sequence: Synthetic oligonucleotide
tcaaaagtgttcacaaaata

SEQ ID NO: 24594 - DNA, 20 bp, Artificial Sequence
  Description of Artificial Sequence: Synthetic oligonucleotide
ttcaaaagtgttcacaaaat

SEQ ID NO: 24595 - DNA, 20 bp, Artificial Sequence
  Description of Artificial Sequence: Synthetic oligonucleotide
tttcaaaagtgttcacaaaa

SEQ ID NO: 24596 - DNA, 20 bp, Artificial Sequence
  Description of Artificial Sequence: Synthetic oligonucleotide
ttttcaaaagtgttcacaaa

SEQ ID NO: 24597 - DNA, 20 bp, Artificial Sequence
  Description of Artificial Sequence: Synthetic oligonucleotide
attttcaaaagtgttcacaa

SEQ ID NO: 24598 - DNA, 20 bp, Artificial Sequence
  Description of Artificial Sequence: Synthetic oligonucleotide
cattttcaaaagtgttcaca

SEQ ID NO: 24599 - DNA, 20 bp, Artificial Sequence
  Description of Artificial Sequence: Synthetic oligonucleotide
acattttcaaaagtgttcac

SEQ ID NO: 24600 - DNA, 20 bp, Artificial Sequence
  Description of Artificial Sequence: Synthetic oligonucleotide
tacattttcaaaagtgttca

SEQ ID NO: 24601 - DNA, 20 bp, Artificial Sequence
  Description of Artificial Sequence: Synthetic oligonucleotide
gtacattttcaaaagtgttc

SEQ ID NO: 24602 - DNA, 20 bp, Artificial Sequence
  Description of Artificial Sequence: Synthetic oligonucleotide
tgtacattttcaaaagtgtt

SEQ ID NO: 24603 - DNA, 20 bp, Artificial Sequence
  Description of Artificial Sequence: Synthetic oligonucleotide
atgtacattttcaaaagtgt

SEQ ID NO: 24604 - DNA, 20 bp, Artificial Sequence
  Description of Artificial Sequence: Synthetic oligonucleotide
catgtacattttcaaaagtg

SEQ ID NO: 24605 - DNA, 20 bp, Artificial Sequence
  Description of Artificial Sequence: Synthetic oligonucleotide
acatgtacattttcaaaagt

SEQ ID NO: 24606 - DNA, 20 bp, Artificial Sequence
  Description of Artificial Sequence: Synthetic oligonucleotide
aacatgtacattttcaaaag

SEQ ID NO: 24607 - DNA, 20 bp, Artificial Sequence
  Description of Artificial Sequence: Synthetic oligonucleotide
gaacatgtacattttcaaaa

SEQ ID NO: 24608 - DNA, 20 bp, Artificial Sequence
  Description of Artificial Sequence: Synthetic oligonucleotide
ggaacatgtacattttcaaa

SEQ ID NO: 24609 - DNA, 20 bp, Artificial Sequence
  Description of Artificial Sequence: Synthetic oligonucleotide
aggaacatgtacattttcaa

SEQ ID NO: 24610 - DNA, 20 bp, Artificial Sequence
  Description of Artificial Sequence: Synthetic oligonucleotide
aaggaacatgtacattttca

SEQ ID NO: 24611 - DNA, 20 bp, Artificial Sequence
  Description of Artificial Sequence: Synthetic oligonucleotide
aaaggaacatgtacattttc

SEQ ID NO: 24612 - DNA, 20 bp, Artificial Sequence
  Description of Artificial Sequence: Synthetic oligonucleotide
caaaggaacatgtacatttt

SEQ ID NO: 24613 - DNA, 20 bp, Artificial Sequence
  Description of Artificial Sequence: Synthetic oligonucleotide
acaaaggaacatgtacattt

SEQ ID NO: 24614 - DNA, 20 bp, Artificial Sequence
  Description of Artificial Sequence: Synthetic oligonucleotide
tacaaaggaacatgtacatt

SEQ ID NO: 24615 - DNA, 20 bp, Artificial Sequence
  Description of Artificial Sequence: Synthetic oligonucleotide
ttacaaaggaacatgtacat

SEQ ID NO: 24616 - DNA, 20 bp, Artificial Sequence
  Description of Artificial Sequence: Synthetic oligonucleotide
attacaaaggaacatgtaca

SEQ ID NO: 24617 - DNA, 20 bp, Artificial Sequence
  Description of Artificial Sequence: Synthetic oligonucleotide
aattacaaaggaacatgtac

SEQ ID NO: 24618 - DNA, 20 bp, Artificial Sequence
  Description of Artificial Sequence: Synthetic oligonucleotide
caattacaaaggaacatgta

SEQ ID NO: 24619 - DNA, 20 bp, Artificial Sequence
  Description of Artificial Sequence: Synthetic oligonucleotide
tcaattacaaaggaacatgt

SEQ ID NO: 24620 - DNA, 20 bp, Artificial Sequence
  Description of Artificial Sequence: Synthetic oligonucleotide
gtcaattacaaaggaacatg

SEQ ID NO: 24621 - DNA, 20 bp, Artificial Sequence
  Description of Artificial Sequence: Synthetic oligonucleotide
tgtcaattacaaaggaacat

SEQ ID NO: 24622 - DNA, 20 bp, Artificial Sequence
  Description of Artificial Sequence: Synthetic oligonucleotide
gtgtcaattacaaaggaaca

SEQ ID NO: 24623 - DNA, 20 bp, Artificial Sequence
  Description of Artificial Sequence: Synthetic oligonucleotide
agtgtcaattacaaaggaac

SEQ ID NO: 24624 - DNA, 20 bp, Artificial Sequence
  Description of Artificial Sequence: Synthetic oligonucleotide
tagtgtcaattacaaaggaa

SEQ ID NO: 24625 - DNA, 20 bp, Artificial Sequence
  Description of Artificial Sequence: Synthetic oligonucleotide
atagtgtcaattacaaagga

SEQ ID NO: 24626 - DNA, 20 bp, Artificial Sequence
  Description of Artificial Sequence: Synthetic oligonucleotide
tatagtgtcaattacaaagg

SEQ ID NO: 24627 - DNA, 20 bp, Artificial Sequence
  Description of Artificial Sequence: Synthetic oligonucleotide
atatagtgtcaattacaaag

SEQ ID NO: 24628 - DNA, 20 bp, Artificial Sequence
  Description of Artificial Sequence: Synthetic oligonucleotide
tatatagtgtcaattacaaa

SEQ ID NO: 24629 - DNA, 20 bp, Artificial Sequence
  Description of Artificial Sequence: Synthetic oligonucleotide
atatatagtgtcaattacaa

SEQ ID NO: 24630 - DNA, 20 bp, Artificial Sequence
  Description of Artificial Sequence: Synthetic oligonucleotide
aatatatagtgtcaattaca

SEQ ID NO: 24631 - DNA, 20 bp, Artificial Sequence
  Description of Artificial Sequence: Synthetic oligonucleotide
aaatatatagtgtcaattac

SEQ ID NO: 24632 - DNA, 20 bp, Artificial Sequence
  Description of Artificial Sequence: Synthetic oligonucleotide
gaaatatatagtgtcaatta

SEQ ID NO: 24633 - DNA, 20 bp, Artificial Sequence
  Description of Artificial Sequence: Synthetic oligonucleotide
agaaatatatagtgtcaatt

SEQ ID NO: 24634 - DNA, 20 bp, Artificial Sequence
  Description of Artificial Sequence: Synthetic oligonucleotide
aagaaatatatagtgtcaat

SEQ ID NO: 24635 - DNA, 20 bp, Artificial Sequence
  Description of Artificial Sequence: Synthetic oligonucleotide
taagaaatatatagtgtcaa

SEQ ID NO: 24636 - DNA, 20 bp, Artificial Sequence
  Description of Artificial Sequence: Synthetic oligonucleotide
ttaagaaatatatagtgtca

SEQ ID NO: 24637 - DNA, 20 bp, Artificial Sequence
  Description of Artificial Sequence: Synthetic oligonucleotide
attaagaaatatatagtgtc

SEQ ID NO: 24638 - DNA, 20 bp, Artificial Sequence
  Description of Artificial Sequence: Synthetic oligonucleotide
tattaagaaatatatagtgt

SEQ ID NO: 24639 - DNA, 20 bp, Artificial Sequence
  Description of Artificial Sequence: Synthetic oligonucleotide
ttattaagaaatatatagtg

SEQ ID NO: 24640 - DNA, 20 bp, Artificial Sequence
  Description of Artificial Sequence: Synthetic oligonucleotide
tttattaagaaatatatagt

SEQ ID NO: 24641 - DNA, 20 bp, Artificial Sequence
  Description of Artificial Sequence: Synthetic oligonucleotide
ttttattaagaaatatatag

SEQ ID NO: 24642 - DNA, 20 bp, Artificial Sequence
  Description of Artificial Sequence: Synthetic oligonucleotide
attttattaagaaatatata

SEQ ID NO: 24643 - DNA, 20 bp, Artificial Sequence
  Description of Artificial Sequence: Synthetic oligonucleotide
tattttattaagaaatatat

SEQ ID NO: 24644 - DNA, 20 bp, Artificial Sequence
  Description of Artificial Sequence: Synthetic oligonucleotide
ttattttattaagaaatata

SEQ ID NO: 24645 - DNA, 20 bp, Artificial Sequence
  Description of Artificial Sequence: Synthetic oligonucleotide
attattttattaagaaatat

SEQ ID NO: 24646 - DNA, 20 bp, Artificial Sequence
  Description of Artificial Sequence: Synthetic oligonucleotide
aattattttattaagaaata

SEQ ID NO: 24647 - DNA, 20 bp, Artificial Sequence
  Description of Artificial Sequence: Synthetic oligonucleotide
gaattattttattaagaaat

SEQ ID NO: 24648 - DNA, 20 bp, Artificial Sequence
  Description of Artificial Sequence: Synthetic oligonucleotide
agaattattttattaagaaa

SEQ ID NO: 24649 - DNA, 20 bp, Artificial Sequence
  Description of Artificial Sequence: Synthetic oligonucleotide
gagaattattttattaagaa

SEQ ID NO: 24650 - DNA, 20 bp, Artificial Sequence
  Description of Artificial Sequence: Synthetic oligonucleotide
tgagaattattttattaaga

SEQ ID NO: 24651 - DNA, 20 bp, Artificial Sequence
  Description of Artificial Sequence: Synthetic oligonucleotide
ttgagaattattttattaag

SEQ ID NO: 24652 - DNA, 20 bp, Artificial Sequence
  Description of Artificial Sequence: Synthetic oligonucleotide
tttgagaattattttattaa

SEQ ID NO: 24653 - DNA, 20 bp, Artificial Sequence
  Description of Artificial Sequence: Synthetic oligonucleotide
atttgagaattattttatta

SEQ ID NO: 24654 - DNA, 20 bp, Artificial Sequence
  Description of Artificial Sequence: Synthetic oligonucleotide
aatttgagaattattttatt

SEQ ID NO: 24655 - DNA, 20 bp, Artificial Sequence
  Description of Artificial Sequence: Synthetic oligonucleotide
aaatttgagaattattttat

SEQ ID NO: 24656 - DNA, 20 bp, Artificial Sequence
  Description of Artificial Sequence: Synthetic oligonucleotide
caaatttgagaattatttta

SEQ ID NO: 24657 - DNA, 20 bp, Artificial Sequence
  Description of Artificial Sequence: Synthetic oligonucleotide
acaaatttgagaattatttt

SEQ ID NO: 24658 - DNA, 20 bp, Artificial Sequence
  Description of Artificial Sequence: Synthetic oligonucleotide
aacaaatttgagaattattt

SEQ ID NO: 24659 - DNA, 20 bp, Artificial Sequence
  Description of Artificial Sequence: Synthetic oligonucleotide
aaacaaatttgagaattatt

SEQ ID NO: 24660 - DNA, 20 bp, Artificial Sequence
  Description of Artificial Sequence: Synthetic oligonucleotide
gaaacaaatttgagaattat

SEQ ID NO: 24661 - DNA, 20 bp, Artificial Sequence
  Description of Artificial Sequence: Synthetic oligonucleotide
agaaacaaatttgagaatta

SEQ ID NO: 24662 - DNA, 20 bp, Artificial Sequence
  Description of Artificial Sequence: Synthetic oligonucleotide
aagaaacaaatttgagaatt

SEQ ID NO: 24663 - DNA, 20 bp, Artificial Sequence
  Description of Artificial Sequence: Synthetic oligonucleotide
taagaaacaaatttgagaat

SEQ ID NO: 24664 - DNA, 20 bp, Artificial Sequence
  Description of Artificial Sequence: Synthetic oligonucleotide
ataagaaacaaatttgagaa

SEQ ID NO: 24665 - DNA, 20 bp, Artificial Sequence
  Description of Artificial Sequence: Synthetic oligonucleotide
cataagaaacaaatttgaga

SEQ ID NO: 24666 - DNA, 20 bp, Artificial Sequence
  Description of Artificial Sequence: Synthetic oligonucleotide
tcataagaaacaaatttgag

SEQ ID NO: 24667 - DNA, 20 bp, Artificial Sequence
  Description of Artificial Sequence: Synthetic oligonucleotide
ttcataagaaacaaatttga

SEQ ID NO: 24668 - DNA, 20 bp, Artificial Sequence
  Description of Artificial Sequence: Synthetic oligonucleotide
attcataagaaacaaatttg

SEQ ID NO: 24669 - DNA, 20 bp, Artificial Sequence
  Description of Artificial Sequence: Synthetic oligonucleotide
gattcataagaaacaaattt

SEQ ID NO: 24670 - DNA, 20 bp, Artificial Sequence
  Description of Artificial Sequence: Synthetic oligonucleotide
tgattcataagaaacaaatt

SEQ ID NO: 24671 - DNA, 20 bp, Artificial Sequence
  Description of Artificial Sequence: Synthetic oligonucleotide
atgattcataagaaacaaat

SEQ ID NO: 24672 - DNA, 20 bp, Artificial Sequence
  Description of Artificial Sequence: Synthetic oligonucleotide
gatgattcataagaaacaaa

SEQ ID NO: 24673 - DNA, 20 bp, Artificial Sequence
  Description of Artificial Sequence: Synthetic oligonucleotide
agatgattcataagaaacaa

SEQ ID NO: 24674 - DNA, 20 bp, Artificial Sequence
  Description of Artificial Sequence: Synthetic oligonucleotide
gagatgattcataagaaaca

SEQ ID NO: 24675 - DNA, 20 bp, Artificial Sequence
  Description of Artificial Sequence: Synthetic oligonucleotide
agagatgattcataagaaac

SEQ ID NO: 24676 - DNA, 20 bp, Artificial Sequence
  Description of Artificial Sequence: Synthetic oligonucleotide
gagagatgattcataagaaa

SEQ ID NO: 24677 - DNA, 20 bp, Artificial Sequence
  Description of Artificial Sequence: Synthetic oligonucleotide
tgagagatgattcataagaa

SEQ ID NO: 24678 - DNA, 20 bp, Artificial Sequence
  Description of Artificial Sequence: Synthetic oligonucleotide
ttgagagatgattcataaga

SEQ ID NO: 24679 - DNA, 20 bp, Artificial Sequence
  Description of Artificial Sequence: Synthetic oligonucleotide
tttgagagatgattcataag

SEQ ID NO: 24680 - DNA, 20 bp, Artificial Sequence
  Description of Artificial Sequence: Synthetic oligonucleotide
atttgagagatgattcataa

SEQ ID NO: 24681 - DNA, 20 bp, Artificial Sequence
  Description of Artificial Sequence: Synthetic oligonucleotide
gatttgagagatgattcata

SEQ ID NO: 24682 - DNA, 20 bp, Artificial Sequence
  Description of Artificial Sequence: Synthetic oligonucleotide
agatttgagagatgattcat

SEQ ID NO: 24683 - DNA, 20 bp, Artificial Sequence
  Description of Artificial Sequence: Synthetic oligonucleotide
tagatttgagagatgattca

SEQ ID NO: 24684 - DNA, 20 bp, Artificial Sequence
  Description of Artificial Sequence: Synthetic oligonucleotide
ctagatttgagagatgattc

SEQ ID NO: 24685 - DNA, 20 bp, Artificial Sequence
  Description of Artificial Sequence: Synthetic oligonucleotide
actagatttgagagatgatt

SEQ ID NO: 24686 - DNA, 20 bp, Artificial Sequence
  Description of Artificial Sequence: Synthetic oligonucleotide
aactagatttgagagatgat

SEQ ID NO: 24687 - DNA, 20 bp, Artificial Sequence
  Description of Artificial Sequence: Synthetic oligonucleotide
taactagatttgagagatga

SEQ ID NO: 24688 - DNA, 20 bp, Artificial Sequence
  Description of Artificial Sequence: Synthetic oligonucleotide
ctaactagatttgagagatg

SEQ ID NO: 24689 - DNA, 20 bp, Artificial Sequence
  Description of Artificial Sequence: Synthetic oligonucleotide
tctaactagatttgagagat

SEQ ID NO: 24690 - DNA, 20 bp, Artificial Sequence
  Description of Artificial Sequence: Synthetic oligonucleotide
gtctaactagatttgagaga

SEQ ID NO: 24691 - DNA, 20 bp, Artificial Sequence
  Description of Artificial Sequence: Synthetic oligonucleotide
tgtctaactagatttgagag

SEQ ID NO: 24692 - DNA, 20 bp, Artificial Sequence
  Description of Artificial Sequence: Synthetic oligonucleotide
ttgtctaactagatttgaga

SEQ ID NO: 24693 - DNA, 20 bp, Artificial Sequence
  Description of Artificial Sequence: Synthetic oligonucleotide
attgtctaactagatttgag

SEQ ID NO: 24694 - DNA, 20 bp, Artificial Sequence
  Description of Artificial Sequence: Synthetic oligonucleotide
aattgtctaactagatttga

SEQ ID NO: 24695 - DNA, 20 bp, Artificial Sequence
  Description of Artificial Sequence: Synthetic oligonucleotide
aaattgtctaactagatttg

SEQ ID NO: 24696 - DNA, 20 bp, Artificial Sequence
  Description of Artificial Sequence: Synthetic oligonucleotide
caaattgtctaactagattt

SEQ ID NO: 24697 - DNA, 20 bp, Artificial Sequence
  Description of Artificial Sequence: Synthetic oligonucleotide
gcaaattgtctaactagatt

SEQ ID NO: 24698 - DNA, 20 bp, Artificial Sequence
  Description of Artificial Sequence: Synthetic oligonucleotide
tgcaaattgtctaactagat

SEQ ID NO: 24699 - DNA, 20 bp, Artificial Sequence
  Description of Artificial Sequence: Synthetic oligonucleotide
gtgcaaattgtctaactaga

SEQ ID NO: 24700 - DNA, 20 bp, Artificial Sequence
  Description of Artificial Sequence: Synthetic oligonucleotide
tgtgcaaattgtctaactag

SEQ ID NO: 24701 - DNA, 20 bp, Artificial Sequence
  Description of Artificial Sequence: Synthetic oligonucleotide
gtgtgcaaattgtctaacta

SEQ ID NO: 24702 - DNA, 20 bp, Artificial Sequence
  Description of Artificial Sequence: Synthetic oligonucleotide
tgtgtgcaaattgtctaact

SEQ ID NO: 24703 - DNA, 20 bp, Artificial Sequence
  Description of Artificial Sequence: Synthetic oligonucleotide
atgtgtgcaaattgtctaac

SEQ ID NO: 24704 - DNA, 20 bp, Artificial Sequence
  Description of Artificial Sequence: Synthetic oligonucleotide
tatgtgtgcaaattgtctaa

SEQ ID NO: 24705 - DNA, 20 bp, Artificial Sequence
  Description of Artificial Sequence: Synthetic oligonucleotide
gtatgtgtgcaaattgtcta

SEQ ID NO: 24706 - DNA, 20 bp, Artificial Sequence
  Description of Artificial Sequence: Synthetic oligonucleotide
agtatgtgtgcaaattgtct

SEQ ID NO: 24707 - DNA, 20 bp, Artificial Sequence
  Description of Artificial Sequence: Synthetic oligonucleotide
aagtatgtgtgcaaattgtc

SEQ ID NO: 24708 - DNA, 20 bp, Artificial Sequence
  Description of Artificial Sequence: Synthetic oligonucleotide
aaagtatgtgtgcaaattgt

SEQ ID NO: 24709 - DNA, 20 bp, Artificial Sequence
  Description of Artificial Sequence: Synthetic oligonucleotide
aaaagtatgtgtgcaaattg

SEQ ID NO: 24710 - DNA, 20 bp, Artificial Sequence
  Description of Artificial Sequence: Synthetic oligonucleotide
gaaaagtatgtgtgcaaatt

SEQ ID NO: 24711 - DNA, 20 bp, Artificial Sequence
  Description of Artificial Sequence: Synthetic oligonucleotide
agaaaagtatgtgtgcaaat

SEQ ID NO: 24712 - DNA, 20 bp, Artificial Sequence
  Description of Artificial Sequence: Synthetic oligonucleotide
tagaaaagtatgtgtgcaaa

SEQ ID NO: 24713 - DNA, 20 bp, Artificial Sequence
  Description of Artificial Sequence: Synthetic oligonucleotide
ttagaaaagtatgtgtgcaa

SEQ ID NO: 24714 - DNA, 20 bp, Artificial Sequence
  Description of Artificial Sequence: Synthetic oligonucleotide
cttagaaaagtatgtgtgca

SEQ ID NO: 24715 - DNA, 20 bp, Artificial Sequence
  Description of Artificial Sequence: Synthetic oligonucleotide
ccttagaaaagtatgtgtgc

SEQ ID NO: 24716 - DNA, 20 bp, Artificial Sequence
  Description of Artificial Sequence: Synthetic oligonucleotide
cccttagaaaagtatgtgtg

SEQ ID NO: 24717 - DNA, 20 bp, Artificial Sequence
  Description of Artificial Sequence: Synthetic oligonucleotide
tcccttagaaaagtatgtgt

SEQ ID NO: 24718 - DNA, 20 bp, Artificial Sequence
  Description of Artificial Sequence: Synthetic oligonucleotide
gtcccttagaaaagtatgtg

SEQ ID NO: 24719 - DNA, 20 bp, Artificial Sequence
  Description of Artificial Sequence: Synthetic oligonucleotide
tgtcccttagaaaagtatgt

SEQ ID NO: 24720 - DNA, 20 bp, Artificial Sequence
  Description of Artificial Sequence: Synthetic oligonucleotide
atgtcccttagaaaagtatg

SEQ ID NO: 24721 - DNA, 20 bp, Artificial Sequence
  Description of Artificial Sequence: Synthetic oligonucleotide
aatgtcccttagaaaagtat

SEQ ID NO: 24722 - DNA, 20 bp, Artificial Sequence
  Description of Artificial Sequence: Synthetic oligonucleotide
taatgtcccttagaaaagta

SEQ ID NO: 24723 - DNA, 20 bp, Artificial Sequence
  Description of Artificial Sequence: Synthetic oligonucleotide
ataatgtcccttagaaaagt

SEQ ID NO: 24724 - DNA, 20 bp, Artificial Sequence
  Description of Artificial Sequence: Synthetic oligonucleotide
gataatgtcccttagaaaag

SEQ ID NO: 24725 - DNA, 20 bp, Artificial Sequence
  Description of Artificial Sequence: Synthetic oligonucleotide
agataatgtcccttagaaaa

SEQ ID NO: 24726 - DNA, 20 bp, Artificial Sequence
  Description of Artificial Sequence: Synthetic oligonucleotide
aagataatgtcccttagaaa

SEQ ID NO: 24727 - DNA, 20 bp, Artificial Sequence
  Description of Artificial Sequence: Synthetic oligonucleotide
gaagataatgtcccttagaa

SEQ ID NO: 24728 - DNA, 20 bp, Artificial Sequence
  Description of Artificial Sequence: Synthetic oligonucleotide
ggaagataatgtcccttaga

SEQ ID NO: 24729 - DNA, 20 bp, Artificial Sequence
  Description of Artificial Sequence: Synthetic oligonucleotide
aggaagataatgtcccttag

SEQ ID NO: 24730 - DNA, 20 bp, Artificial Sequence
  Description of Artificial Sequence: Synthetic oligonucleotide
aaggaagataatgtccctta

SEQ ID NO: 24731 - DNA, 20 bp, Artificial Sequence
  Description of Artificial Sequence: Synthetic oligonucleotide
gaaggaagataatgtccctt

SEQ ID NO: 24732 - DNA, 20 bp, Artificial Sequence
  Description of Artificial Sequence: Synthetic oligonucleotide
tgaaggaagataatgtccct

SEQ ID NO: 24733 - DNA, 20 bp, Artificial Sequence
  Description of Artificial Sequence: Synthetic oligonucleotide
ctgaaggaagataatgtccc

SEQ ID NO: 24734 - DNA, 20 bp, Artificial Sequence
  Description of Artificial Sequence: Synthetic oligonucleotide
cctgaaggaagataatgtcc

SEQ ID NO: 24735 - DNA, 20 bp, Artificial Sequence
  Description of Artificial Sequence: Synthetic oligonucleotide
acctgaaggaagataatgtc

SEQ ID NO: 24736 - DNA, 20 bp, Artificial Sequence
  Description of Artificial Sequence: Synthetic oligonucleotide
aacctgaaggaagataatgt

SEQ ID NO: 24737 - DNA, 20 bp, Artificial Sequence
  Description of Artificial Sequence: Synthetic oligonucleotide
aaacctgaaggaagataatg

SEQ ID NO: 24738 - DNA, 20 bp, Artificial Sequence
  Description of Artificial Sequence: Synthetic oligonucleotide
aaaacctgaaggaagataat

SEQ ID NO: 24739 - DNA, 20 bp, Artificial Sequence
  Description of Artificial Sequence: Synthetic oligonucleotide
aaaaacctgaaggaagataa

SEQ ID NO: 24740 - DNA, 20 bp, Artificial Sequence
  Description of Artificial Sequence: Synthetic oligonucleotide
taaaaacctgaaggaagata

SEQ ID NO: 24741 - DNA, 20 bp, Artificial Sequence
  Description of Artificial Sequence: Synthetic oligonucleotide
gtaaaaacctgaaggaagat

SEQ ID NO: 24742 - DNA, 20 bp, Artificial Sequence
  Description of Artificial Sequence: Synthetic oligonucleotide
ggtaaaaacctgaaggaaga

SEQ ID NO: 24743 - DNA, 20 bp, Artificial Sequence
  Description of Artificial Sequence: Synthetic oligonucleotide
aggtaaaaacctgaaggaag

SEQ ID NO: 24744 - DNA, 20 bp, Artificial Sequence
  Description of Artificial Sequence: Synthetic oligonucleotide
gaggtaaaaacctgaaggaa

SEQ ID NO: 24745 - DNA, 20 bp, Artificial Sequence
  Description of Artificial Sequence: Synthetic oligonucleotide
ggaggtaaaaacctgaagga

SEQ ID NO: 24746 - DNA, 20 bp, Artificial Sequence
  Description of Artificial Sequence: Synthetic oligonucleotide
tggaggtaaaaacctgaagg

SEQ ID NO: 24747 - DNA, 20 bp, Artificial Sequence
  Description of Artificial Sequence: Synthetic oligonucleotide
gtggaggtaaaaacctgaag

SEQ ID NO: 24748 - DNA, 20 bp, Artificial Sequence
  Description of Artificial Sequence: Synthetic oligonucleotide
agtggaggtaaaaacctgaa

SEQ ID NO: 24749 - DNA, 20 bp, Artificial Sequence
  Description of Artificial Sequence: Synthetic oligonucleotide
gagtggaggtaaaaacctga

SEQ ID NO: 24750 - DNA, 20 bp, Artificial Sequence
  Description of Artificial Sequence: Synthetic oligonucleotide
tgagtggaggtaaaaacctg

SEQ ID NO: 24751 - DNA, 20 bp, Artificial Sequence
  Description of Artificial Sequence: Synthetic oligonucleotide
atgagtggaggtaaaaacct

SEQ ID NO: 24752 - DNA, 20 bp, Artificial Sequence
  Description of Artificial Sequence: Synthetic oligonucleotide
gatgagtggaggtaaaaacc

SEQ ID NO: 24753 - DNA, 20 bp, Artificial Sequence
  Description of Artificial Sequence: Synthetic oligonucleotide
ggatgagtggaggtaaaaac

SEQ ID NO: 24754 - DNA, 20 bp, Artificial Sequence
  Description of Artificial Sequence: Synthetic oligonucleotide
aggatgagtggaggtaaaaa

SEQ ID NO: 24755 - DNA, 20 bp, Artificial Sequence
  Description of Artificial Sequence: Synthetic oligonucleotide
aaggatgagtggaggtaaaa

SEQ ID NO: 24756 - DNA, 20 bp, Artificial Sequence
  Description of Artificial Sequence: Synthetic oligonucleotide
taaggatgagtggaggtaaa

SEQ ID NO: 24757 - DNA, 20 bp, Artificial Sequence
  Description of Artificial Sequence: Synthetic oligonucleotide
ctaaggatgagtggaggtaa

SEQ ID NO: 24758 - DNA, 20 bp, Artificial Sequence
  Description of Artificial Sequence: Synthetic oligonucleotide
tctaaggatgagtggaggta

SEQ ID NO: 24759 - DNA, 20 bp, Artificial Sequence
  Description of Artificial Sequence: Synthetic oligonucleotide
ctctaaggatgagtggaggt

SEQ ID NO: 24760 - DNA, 20 bp, Artificial Sequence
  Description of Artificial Sequence: Synthetic oligonucleotide
gctctaaggatgagtggagg

SEQ ID NO: 24761 - DNA, 20 bp, Artificial Sequence
  Description of Artificial Sequence: Synthetic oligonucleotide
ggctctaaggatgagtggag

SEQ ID NO: 24762 - DNA, 20 bp, Artificial Sequence
  Description of Artificial Sequence: Synthetic oligonucleotide
gggctctaaggatgagtgga

SEQ ID NO: 24763 - DNA, 20 bp, Artificial Sequence
  Description of Artificial Sequence: Synthetic oligonucleotide
tgggctctaaggatgagtgg

SEQ ID NO: 24764 - DNA, 20 bp, Artificial Sequence
  Description of Artificial Sequence: Synthetic oligonucleotide
gtgggctctaaggatgagtg

SEQ ID NO: 24765 - DNA, 20 bp, Artificial Sequence
  Description of Artificial Sequence: Synthetic oligonucleotide
agtgggctctaaggatgagt

SEQ ID NO: 24766 - DNA, 20 bp, Artificial Sequence
  Description of Artificial Sequence: Synthetic oligonucleotide
cagtgggctctaaggatgag

SEQ ID NO: 24767 - DNA, 20 bp, Artificial Sequence
  Description of Artificial Sequence: Synthetic oligonucleotide
tcagtgggctctaaggatga

SEQ ID NO: 24768 - DNA, 20 bp, Artificial Sequence
  Description of Artificial Sequence: Synthetic oligonucleotide
gtcagtgggctctaaggatg

SEQ ID NO: 24769 - DNA, 20 bp, Artificial Sequence
  Description of Artificial Sequence: Synthetic oligonucleotide
agtcagtgggctctaaggat

SEQ ID NO: 24770 - DNA, 20 bp, Artificial Sequence
  Description of Artificial Sequence: Synthetic oligonucleotide
cagtcagtgggctctaagga

SEQ ID NO: 24771 - DNA, 20 bp, Artificial Sequence
  Description of Artificial Sequence: Synthetic oligonucleotide
gcagtcagtgggctctaagg

SEQ ID NO: 24772 - DNA, 20 bp, Artificial Sequence
  Description of Artificial Sequence: Synthetic oligonucleotide
agcagtcagtgggctctaag

SEQ ID NO: 24773 - DNA, 20 bp, Artificial Sequence
  Description of Artificial Sequence: Synthetic oligonucleotide
gagcagtcagtgggctctaa

SEQ ID NO: 24774 - DNA, 20 bp, Artificial Sequence
  Description of Artificial Sequence: Synthetic oligonucleotide
ggagcagtcagtgggctcta

SEQ ID NO: 24775 - DNA, 20 bp, Artificial Sequence
  Description of Artificial Sequence: Synthetic oligonucleotide
gggagcagtcagtgggctct

SEQ ID NO: 24776 - DNA, 20 bp, Artificial Sequence
  Description of Artificial Sequence: Synthetic oligonucleotide
ggggagcagtcagtgggctc

SEQ ID NO: 24777 - DNA, 20 bp, Artificial Sequence
  Description of Artificial Sequence: Synthetic oligonucleotide
aggggagcagtcagtgggct

SEQ ID NO: 24778 - DNA, 20 bp, Artificial Sequence
  Description of Artificial Sequence: Synthetic oligonucleotide
aaggggagcagtcagtgggc

SEQ ID NO: 24779 - DNA, 20 bp, Artificial Sequence
  Description of Artificial Sequence: Synthetic oligonucleotide
aaaggggagcagtcagtggg

SEQ ID NO: 24780 - DNA, 20 bp, Artificial Sequence
  Description of Artificial Sequence: Synthetic oligonucleotide
taaaggggagcagtcagtgg

SEQ ID NO: 24781 - DNA, 20 bp, Artificial Sequence
  Description of Artificial Sequence: Synthetic oligonucleotide
ataaaggggagcagtcagtg

SEQ ID NO: 24782 - DNA, 20 bp, Artificial Sequence
  Description of Artificial Sequence: Synthetic oligonucleotide
tataaaggggagcagtcagt

SEQ ID NO: 24783 - DNA, 20 bp, Artificial Sequence
  Description of Artificial Sequence: Synthetic oligonucleotide
gtataaaggggagcagtcag

SEQ ID NO: 24784 - DNA, 20 bp, Artificial Sequence
  Description of Artificial Sequence: Synthetic oligonucleotide
ggtataaaggggagcagtca

SEQ ID NO: 24785 - DNA, 20 bp, Artificial Sequence
  Description of Artificial Sequence: Synthetic oligonucleotide
aggtataaaggggagcagtc

SEQ ID NO: 24786 - DNA, 20 bp, Artificial Sequence
  Description of Artificial Sequence: Synthetic oligonucleotide
caggtataaaggggagcagt

SEQ ID NO: 24787 - DNA, 20 bp, Artificial Sequence
  Description of Artificial Sequence: Synthetic oligonucleotide
acaggtataaaggggagcag

SEQ ID NO: 24788 - DNA, 20 bp, Artificial Sequence
  Description of Artificial Sequence: Synthetic oligonucleotide
aacaggtataaaggggagca

SEQ ID NO: 24789 - DNA, 20 bp, Artificial Sequence
  Description of Artificial Sequence: Synthetic oligonucleotide
caacaggtataaaggggagc

SEQ ID NO: 24790 - DNA, 20 bp, Artificial Sequence
  Description of Artificial Sequence: Synthetic oligonucleotide
ccaacaggtataaaggggag

SEQ ID NO: 24791 - DNA, 20 bp, Artificial Sequence
  Description of Artificial Sequence: Synthetic oligonucleotide
gccaacaggtataaagggga

SEQ ID NO: 24792 - DNA, 20 bp, Artificial Sequence
  Description of Artificial Sequence: Synthetic oligonucleotide
ggccaacaggtataaagggg

SEQ ID NO: 24793 - DNA, 20 bp, Artificial Sequence
  Description of Artificial Sequence: Synthetic oligonucleotide
gggccaacaggtataaaggg

SEQ ID NO: 24794 - DNA, 20 bp, Artificial Sequence
  Description of Artificial Sequence: Synthetic oligonucleotide
agggccaacaggtataaagg

SEQ ID NO: 24795 - DNA, 20 bp, Artificial Sequence
  Description of Artificial Sequence: Synthetic oligonucleotide
cagggccaacaggtataaag

SEQ ID NO: 24796 - DNA, 20 bp, Artificial Sequence
  Description of Artificial Sequence: Synthetic oligonucleotide
gcagggccaacaggtataaa

SEQ ID NO: 24797 - DNA, 20 bp, Artificial Sequence
  Description of Artificial Sequence: Synthetic oligonucleotide
ggcagggccaacaggtataa

SEQ ID NO: 24798 - DNA, 20 bp, Artificial Sequence
  Description of Artificial Sequence: Synthetic oligonucleotide
aggcagggccaacaggtata

SEQ ID NO: 24799 - DNA, 20 bp, Artificial Sequence
  Description of Artificial Sequence: Synthetic oligonucleotide
taggcagggccaacaggtat

SEQ ID NO: 24800 - DNA, 20 bp, Artificial Sequence
  Description of Artificial Sequence: Synthetic oligonucleotide
ataggcagggccaacaggta

SEQ ID NO: 24801 - DNA, 20 bp, Artificial Sequence
  Description of Artificial Sequence: Synthetic oligonucleotide
tataggcagggccaacaggt

SEQ ID NO: 24802 - DNA, 20 bp, Artificial Sequence
  Description of Artificial Sequence: Synthetic oligonucleotide
ctataggcagggccaacagg

SEQ ID NO: 24803 - DNA, 20 bp, Artificial Sequence
  Description of Artificial Sequence: Synthetic oligonucleotide
cctataggcagggccaacag

SEQ ID NO: 24804 - DNA, 20 bp, Artificial Sequence
  Description of Artificial Sequence: Synthetic oligonucleotide
tcctataggcagggccaaca

SEQ ID NO: 24805 - DNA, 20 bp, Artificial Sequence
  Description of Artificial Sequence: Synthetic oligonucleotide
ctcctataggcagggccaac

SEQ ID NO: 24806 - DNA, 20 bp, Artificial Sequence
  Description of Artificial Sequence: Synthetic oligonucleotide
tctcctataggcagggccaa

SEQ ID NO: 24807 - DNA, 20 bp, Artificial Sequence
  Description of Artificial Sequence: Synthetic oligonucleotide
ctctcctataggcagggcca

SEQ ID NO: 24808 - DNA, 20 bp, Artificial Sequence
  Description of Artificial Sequence: Synthetic oligonucleotide
tctctcctataggcagggcc

SEQ ID NO: 24809 - DNA, 20 bp, Artificial Sequence
  Description of Artificial Sequence: Synthetic oligonucleotide
ttctctcctataggcagggc

SEQ ID NO: 24810 - DNA, 20 bp, Artificial Sequence
  Description of Artificial Sequence: Synthetic oligonucleotide
attctctcctataggcaggg

SEQ ID NO: 24811 - DNA, 20 bp, Artificial Sequence
  Description of Artificial Sequence: Synthetic oligonucleotide
tattctctcctataggcagg

SEQ ID NO: 24812 - DNA, 20 bp, Artificial Sequence
  Description of Artificial Sequence: Synthetic oligonucleotide
atattctctcctataggcag

SEQ ID NO: 24813 - DNA, 20 bp, Artificial Sequence
  Description of Artificial Sequence: Synthetic oligonucleotide
aatattctctcctataggca

SEQ ID NO: 24814 - DNA, 20 bp, Artificial Sequence
  Description of Artificial Sequence: Synthetic oligonucleotide
aaatattctctcctataggc

SEQ ID NO: 24815 - DNA, 20 bp, Artificial Sequence
  Description of Artificial Sequence: Synthetic oligonucleotide
caaatattctctcctatagg

SEQ ID NO: 24816 - DNA, 20 bp, Artificial Sequence
  Description of Artificial Sequence: Synthetic oligonucleotide
ccaaatattctctcctatag

SEQ ID NO: 24817 - DNA, 20 bp, Artificial Sequence
  Description of Artificial Sequence: Synthetic oligonucleotide
tccaaatattctctcctata

SEQ ID NO: 24818 - DNA, 20 bp, Artificial Sequence
  Description of Artificial Sequence: Synthetic oligonucleotide
ctccaaatattctctcctat

SEQ ID NO: 24819 - DNA, 20 bp, Artificial Sequence
  Description of Artificial Sequence: Synthetic oligonucleotide
tctccaaatattctctccta

SEQ ID NO: 24820 - DNA, 20 bp, Artificial Sequence
  Description of Artificial Sequence: Synthetic oligonucleotide
atctccaaatattctctcct

SEQ ID NO: 24821 - DNA, 20 bp, Artificial Sequence
  Description of Artificial Sequence: Synthetic oligonucleotide
tatctccaaatattctctcc

SEQ ID NO: 24822 - DNA, 20 bp, Artificial Sequence
  Description of Artificial Sequence: Synthetic oligonucleotide
ctatctccaaatattctctc

SEQ ID NO: 24823 - DNA, 20 bp, Artificial Sequence
  Description of Artificial Sequence: Synthetic oligonucleotide
cctatctccaaatattctct

SEQ ID NO: 24824 - DNA, 20 bp, Artificial Sequence
  Description of Artificial Sequence: Synthetic oligonucleotide
gcctatctccaaatattctc

SEQ ID NO: 24825 - DNA, 20 bp, Artificial Sequence
  Description of Artificial Sequence: Synthetic oligonucleotide
tgcctatctccaaatattct

SEQ ID NO: 24826 - DNA, 20 bp, Artificial Sequence
  Description of Artificial Sequence: Synthetic oligonucleotide
ctgcctatctccaaatattc

SEQ ID NO: 24827 - DNA, 20 bp, Artificial Sequence
  Description of Artificial Sequence: Synthetic oligonucleotide
gctgcctatctccaaatatt

SEQ ID NO: 24828 - DNA, 20 bp, Artificial Sequence
  Description of Artificial Sequence: Synthetic oligonucleotide
agctgcctatctccaaatat

SEQ ID NO: 24829 - DNA, 20 bp, Artificial Sequence
  Description of Artificial Sequence: Synthetic oligonucleotide
aagctgcctatctccaaata

SEQ ID NO: 24830 - DNA, 20 bp, Artificial Sequence
  Description of Artificial Sequence: Synthetic oligonucleotide
gaagctgcctatctccaaat

SEQ ID NO: 24831 - DNA, 20 bp, Artificial Sequence
  Description of Artificial Sequence: Synthetic oligonucleotide
tgaagctgcctatctccaaa

SEQ ID NO: 24832 - DNA, 20 bp, Artificial Sequence
  Description of Artificial Sequence: Synthetic oligonucleotide
ctgaagctgcctatctccaa

SEQ ID NO: 24833 - DNA, 20 bp, Artificial Sequence
  Description of Artificial Sequence: Synthetic oligonucleotide
cctgaagctgcctatctcca

SEQ ID NO: 24834 - DNA, 20 bp, Artificial Sequence
  Description of Artificial Sequence: Synthetic oligonucleotide
tcctgaagctgcctatctcc

SEQ ID NO: 24835 - DNA, 20 bp, Artificial Sequence
  Description of Artificial Sequence: Synthetic oligonucleotide
atcctgaagctgcctatctc

SEQ ID NO: 24836 - DNA, 20 bp, Artificial Sequence
  Description of Artificial Sequence: Synthetic oligonucleotide
catcctgaagctgcctatct

SEQ ID NO: 24837 - DNA, 20 bp, Artificial Sequence
  Description of Artificial Sequence: Synthetic oligonucleotide
gcatcctgaagctgcctatc

SEQ ID NO: 24838 - DNA, 20 bp, Artificial Sequence
  Description of Artificial Sequence: Synthetic oligonucleotide
tgcatcctgaagctgcctat

SEQ ID NO: 24839 - DNA, 20 bp, Artificial Sequence
  Description of Artificial Sequence: Synthetic oligonucleotide
atgcatcctgaagctgccta

SEQ ID NO: 24840 - DNA, 20 bp, Artificial Sequence
  Description of Artificial Sequence: Synthetic oligonucleotide
aatgcatcctgaagctgcct

SEQ ID NO: 24841 - DNA, 20 bp, Artificial Sequence
  Description of Artificial Sequence: Synthetic oligonucleotide
caatgcatcctgaagctgcc

SEQ ID NO: 24842 - DNA, 20 bp, Artificial Sequence
  Description of Artificial Sequence: Synthetic oligonucleotide
gcaatgcatcctgaagctgc

SEQ ID NO: 24843 - DNA, 20 bp, Artificial Sequence
  Description of Artificial Sequence: Synthetic oligonucleotide
tgcaatgcatcctgaagctg

SEQ ID NO: 24844 - DNA, 20 bp, Artificial Sequence
  Description of Artificial Sequence: Synthetic oligonucleotide
ttgcaatgcatcctgaagct

SEQ ID NO: 24845 - DNA, 20 bp, Artificial Sequence
  Description of Artificial Sequence: Synthetic oligonucleotide
attgcaatgcatcctgaagc

SEQ ID NO: 24846 - DNA, 20 bp, Artificial Sequence
  Description of Artificial Sequence: Synthetic oligonucleotide
gattgcaatgcatcctgaag

SEQ ID NO: 24847 - DNA, 20 bp, Artificial Sequence
  Description of Artificial Sequence: Synthetic oligonucleotide
tgattgcaatgcatcctgaa

SEQ ID NO: 24848 - DNA, 20 bp, Artificial Sequence
  Description of Artificial Sequence: Synthetic oligonucleotide
atgattgcaatgcatcctga

SEQ ID NO: 24849 - DNA, 20 bp, Artificial Sequence
  Description of Artificial Sequence: Synthetic oligonucleotide
gatgattgcaatgcatcctg

SEQ ID NO: 24850 - DNA, 20 bp, Artificial Sequence
  Description of Artificial Sequence: Synthetic oligonucleotide
ggatgattgcaatgcatcct

SEQ ID NO: 24851 - DNA, 20 bp, Artificial Sequence
  Description of Artificial Sequence: Synthetic oligonucleotide
aggatgattgcaatgcatcc

SEQ ID NO: 24852 - DNA, 20 bp, Artificial Sequence
  Description of Artificial Sequence: Synthetic oligonucleotide
aaggatgattgcaatgcatc

SEQ ID NO: 24853 - DNA, 20 bp, Artificial Sequence
  Description of Artificial Sequence: Synthetic oligonucleotide
aaaggatgattgcaatgcat

SEQ ID NO: 24854 - DNA, 20 bp, Artificial Sequence
  Description of Artificial Sequence: Synthetic oligonucleotide
aaaaggatgattgcaatgca

SEQ ID NO: 24855 - DNA, 20 bp, Artificial Sequence
  Description of Artificial Sequence: Synthetic oligonucleotide
gaaaaggatgattgcaatgc

SEQ ID NO: 24856 - DNA, 20 bp, Artificial Sequence
  Description of Artificial Sequence: Synthetic oligonucleotide
agaaaaggatgattgcaatg

SEQ ID NO: 24857 - DNA, 20 bp, Artificial Sequence
  Description of Artificial Sequence: Synthetic oligonucleotide
aagaaaaggatgattgcaat

SEQ ID NO: 24858 - DNA, 20 bp, Artificial Sequence
  Description of Artificial Sequence: Synthetic oligonucleotide
taagaaaaggatgattgcaa

SEQ ID NO: 24859 - DNA, 20 bp, Artificial Sequence
  Description of Artificial Sequence: Synthetic oligonucleotide
ttaagaaaaggatgattgca

SEQ ID NO: 24860 - DNA, 20 bp, Artificial Sequence
  Description of Artificial Sequence: Synthetic oligonucleotide
tttaagaaaaggatgattgc

SEQ ID NO: 24861 - DNA, 20 bp, Artificial Sequence
  Description of Artificial Sequence: Synthetic oligonucleotide
atttaagaaaaggatgattg

SEQ ID NO: 24862 - DNA, 20 bp, Artificial Sequence
  Description of Artificial Sequence: Synthetic oligonucleotide
aatttaagaaaaggatgatt

SEQ ID NO: 24863 - DNA, 20 bp, Artificial Sequence
  Description of Artificial Sequence: Synthetic oligonucleotide
taatttaagaaaaggatgat

SEQ ID NO: 24864 - DNA, 20 bp, Artificial Sequence
  Description of Artificial Sequence: Synthetic oligonucleotide
ataatttaagaaaaggatga

SEQ ID NO: 24865 - DNA, 20 bp, Artificial Sequence
  Description of Artificial Sequence: Synthetic oligonucleotide
cataatttaagaaaaggatg

SEQ ID NO: 24866 - DNA, 20 bp, Artificial Sequence
  Description of Artificial Sequence: Synthetic oligonucleotide
acataatttaagaaaaggat

SEQ ID NO: 24867 - DNA, 20 bp, Artificial Sequence
  Description of Artificial Sequence: Synthetic oligonucleotide
gacataatttaagaaaagga

SEQ ID NO: 24868 - DNA, 20 bp, Artificial Sequence
  Description of Artificial Sequence: Synthetic oligonucleotide
tgacataatttaagaaaagg

SEQ ID NO: 24869 - DNA, 20 bp, Artificial Sequence
  Description of Artificial Sequence: Synthetic oligonucleotide
gtgacataatttaagaaaag

SEQ ID NO: 24870 - DNA, 20 bp, Artificial Sequence
  Description of Artificial Sequence: Synthetic oligonucleotide
agtgacataatttaagaaaa

SEQ ID NO: 24871 - DNA, 20 bp, Artificial Sequence
  Description of Artificial Sequence: Synthetic oligonucleotide
tagtgacataatttaagaaa

SEQ ID NO: 24872 - DNA, 20 bp, Artificial Sequence
  Description of Artificial Sequence: Synthetic oligonucleotide
ctagtgacataatttaagaa

SEQ ID NO: 24873 - DNA, 20 bp, Artificial Sequence
  Description of Artificial Sequence: Synthetic oligonucleotide
actagtgacataatttaaga

SEQ ID NO: 24874 - DNA, 20 bp, Artificial Sequence
  Description of Artificial Sequence: Synthetic oligonucleotide
gactagtgacataatttaag

SEQ ID NO: 24875 - DNA, 20 bp, Artificial Sequence
  Description of Artificial Sequence: Synthetic oligonucleotide
agactagtgacataatttaa

SEQ ID NO: 24876 - DNA, 20 bp, Artificial Sequence
  Description of Artificial Sequence: Synthetic oligonucleotide
aagactagtgacataattta

SEQ ID NO: 24877 - DNA, 20 bp, Artificial Sequence
  Description of Artificial Sequence: Synthetic oligonucleotide
aaagactagtgacataattt

SEQ ID NO: 24878 - DNA, 20 bp, Artificial Sequence
  Description of Artificial Sequence: Synthetic oligonucleotide
aaaagactagtgacataatt

SEQ ID NO: 24879 - DNA, 20 bp, Artificial Sequence
  Description of Artificial Sequence: Synthetic oligonucleotide
taaaagactagtgacataat

SEQ ID NO: 24880 - DNA, 20 bp, Artificial Sequence
  Description of Artificial Sequence: Synthetic oligonucleotide
ataaaagactagtgacataa

SEQ ID NO: 24881 - DNA, 20 bp, Artificial Sequence
  Description of Artificial Sequence: Synthetic oligonucleotide
aataaaagactagtgacata

SEQ ID NO: 24882 - DNA, 20 bp, Artificial Sequence
  Description of Artificial Sequence: Synthetic oligonucleotide
aaataaaagactagtgacat

SEQ ID NO: 24883 - DNA, 20 bp, Artificial Sequence
  Description of Artificial Sequence: Synthetic oligonucleotide
aaaataaaagactagtgaca

SEQ ID NO: 24884 - DNA, 20 bp, Artificial Sequence
  Description of Artificial Sequence: Synthetic oligonucleotide
aaaaataaaagactagtgac

SEQ ID NO: 24885 - DNA, 20 bp, Artificial Sequence
  Description of Artificial Sequence: Synthetic oligonucleotide
aaaaaataaaagactagtga

SEQ ID NO: 24886 - DNA, 20 bp, Artificial Sequence
  Description of Artificial Sequence: Synthetic oligonucleotide
gaaaaaataaaagactagtg

SEQ ID NO: 24887 - DNA, 20 bp, Artificial Sequence
  Description of Artificial Sequence: Synthetic oligonucleotide
ggaaaaaataaaagactagt

SEQ ID NO: 24888 - DNA, 20 bp, Artificial Sequence
  Description of Artificial Sequence: Synthetic oligonucleotide
gggaaaaaataaaagactag

SEQ ID NO: 24889 - DNA, 20 bp, Artificial Sequence
  Description of Artificial Sequence: Synthetic oligonucleotide
ggggaaaaaataaaagacta

SEQ ID NO: 24890 - DNA, 20 bp, Artificial Sequence
  Description of Artificial Sequence: Synthetic oligonucleotide
aggggaaaaaataaaagact

SEQ ID NO: 24891 - DNA, 20 bp, Artificial Sequence
  Description of Artificial Sequence: Synthetic oligonucleotide
gaggggaaaaaataaaagac

SEQ ID NO: 24892 - DNA, 20 bp, Artificial Sequence
  Description of Artificial Sequence: Synthetic oligonucleotide
agaggggaaaaaataaaaga

SEQ ID NO: 24893 - DNA, 20 bp, Artificial Sequence
  Description of Artificial Sequence: Synthetic oligonucleotide
aagaggggaaaaaataaaag

SEQ ID NO: 24894 - DNA, 20 bp, Artificial Sequence
  Description of Artificial Sequence: Synthetic oligonucleotide
caagaggggaaaaaataaaa

SEQ ID NO: 24895 - DNA, 20 bp, Artificial Sequence
  Description of Artificial Sequence: Synthetic oligonucleotide
tcaagaggggaaaaaataaa

SEQ ID NO: 24896 - DNA, 20 bp, Artificial Sequence
  Description of Artificial Sequence: Synthetic oligonucleotide
ttcaagaggggaaaaaataa

SEQ ID NO: 24897 - DNA, 20 bp, Artificial Sequence
  Description of Artificial Sequence: Synthetic oligonucleotide
gttcaagaggggaaaaaata

SEQ ID NO: 24898 - DNA, 20 bp, Artificial Sequence
  Description of Artificial Sequence: Synthetic oligonucleotide
agttcaagaggggaaaaaat

SEQ ID NO: 24899 - DNA, 20 bp, Artificial Sequence
  Description of Artificial Sequence: Synthetic oligonucleotide
aagttcaagaggggaaaaaa

SEQ ID NO: 24900 - DNA, 20 bp, Artificial Sequence
  Description of Artificial Sequence: Synthetic oligonucleotide
aaagttcaagaggggaaaaa

SEQ ID NO: 24901 - DNA, 20 bp, Artificial Sequence
  Description of Artificial Sequence: Synthetic oligonucleotide
gaaagttcaagaggggaaaa

SEQ ID NO: 24902 - DNA, 20 bp, Artificial Sequence
  Description of Artificial Sequence: Synthetic oligonucleotide
ggaaagttcaagaggggaaa

SEQ ID NO: 24903 - DNA, 20 bp, Artificial Sequence
  Description of Artificial Sequence: Synthetic oligonucleotide
aggaaagttcaagaggggaa

SEQ ID NO: 24904 - DNA, 20 bp, Artificial Sequence
  Description of Artificial Sequence: Synthetic oligonucleotide
gaggaaagttcaagagggga

SEQ ID NO: 24905 - DNA, 20 bp, Artificial Sequence
  Description of Artificial Sequence: Synthetic oligonucleotide
tgaggaaagttcaagagggg

SEQ ID NO: 24906 - DNA, 20 bp, Artificial Sequence
  Description of Artificial Sequence: Synthetic oligonucleotide
gtgaggaaagttcaagaggg

SEQ ID NO: 24907 - DNA, 20 bp, Artificial Sequence
  Description of Artificial Sequence: Synthetic oligonucleotide
tgtgaggaaagttcaagagg

SEQ ID NO: 24908 - DNA, 20 bp, Artificial Sequence
  Description of Artificial Sequence: Synthetic oligonucleotide
gtgtgaggaaagttcaagag

SEQ ID NO: 24909 - DNA, 20 bp, Artificial Sequence
  Description of Artificial Sequence: Synthetic oligonucleotide
ggtgtgaggaaagttcaaga

SEQ ID NO: 24910 - DNA, 20 bp, Artificial Sequence
  Description of Artificial Sequence: Synthetic oligonucleotide
aggtgtgaggaaagttcaag

SEQ ID NO: 24911 - DNA, 20 bp, Artificial Sequence
  Description of Artificial Sequence: Synthetic oligonucleotide
caggtgtgaggaaagttcaa

SEQ ID NO: 24912 - DNA, 20 bp, Artificial Sequence
  Description of Artificial Sequence: Synthetic oligonucleotide
ccaggtgtgaggaaagttca

SEQ ID NO: 24913 - DNA, 20 bp, Artificial Sequence
  Description of Artificial Sequence: Synthetic oligonucleotide
tccaggtgtgaggaaagttc

SEQ ID NO: 24914 - DNA, 20 bp, Artificial Sequence
  Description of Artificial Sequence: Synthetic oligonucleotide
ttccaggtgtgaggaaagtt

SEQ ID NO: 24915 - DNA, 20 bp, Artificial Sequence
  Description of Artificial Sequence: Synthetic oligonucleotide
cttccaggtgtgaggaaagt

SEQ ID NO: 24916 - DNA, 20 bp, Artificial Sequence
  Description of Artificial Sequence: Synthetic oligonucleotide
tcttccaggtgtgaggaaag

SEQ ID NO: 24917 - DNA, 20 bp, Artificial Sequence
  Description of Artificial Sequence: Synthetic oligonucleotide
ttcttccaggtgtgaggaaa

SEQ ID NO: 24918 - DNA, 20 bp, Artificial Sequence
  Description of Artificial Sequence: Synthetic oligonucleotide
tttcttccaggtgtgaggaa

SEQ ID NO: 24919 - DNA, 20 bp, Artificial Sequence
  Description of Artificial Sequence: Synthetic oligonucleotide
gtttcttccaggtgtgagga

SEQ ID NO: 24920 - DNA, 20 bp, Artificial Sequence
  Description of Artificial Sequence: Synthetic oligonucleotide
tgtttcttccaggtgtgagg

SEQ ID NO: 24921 - DNA, 20 bp, Artificial Sequence
  Description of Artificial Sequence: Synthetic oligonucleotide
ttgtttcttccaggtgtgag

SEQ ID NO: 24922 - DNA, 20 bp, Artificial Sequence
  Description of Artificial Sequence: Synthetic oligonucleotide
tttgtttcttccaggtgtga

SEQ ID NO: 24923 - DNA, 20 bp, Artificial Sequence
  Description of Artificial Sequence: Synthetic oligonucleotide
ctttgtttcttccaggtgtg

SEQ ID NO: 24924 - DNA, 20 bp, Artificial Sequence
  Description of Artificial Sequence: Synthetic oligonucleotide
actttgtttcttccaggtgt

SEQ ID NO: 24925 - DNA, 20 bp, Artificial Sequence
  Description of Artificial Sequence: Synthetic oligonucleotide
tactttgtttcttccaggtg

SEQ ID NO: 24926 - DNA, 20 bp, Artificial Sequence
  Description of Artificial Sequence: Synthetic oligonucleotide
ctactttgtttcttccaggt

SEQ ID NO: 24927 - DNA, 20 bp, Artificial Sequence
  Description of Artificial Sequence: Synthetic oligonucleotide
cctactttgtttcttccagg

SEQ ID NO: 24928 - DNA, 20 bp, Artificial Sequence
  Description of Artificial Sequence: Synthetic oligonucleotide
tcctactttgtttcttccag

SEQ ID NO: 24929 - DNA, 20 bp, Artificial Sequence
  Description of Artificial Sequence: Synthetic oligonucleotide
ttcctactttgtttcttcca

SEQ ID NO: 24930 - DNA, 20 bp, Artificial Sequence
  Description of Artificial Sequence: Synthetic oligonucleotide
tttcctactttgtttcttcc

SEQ ID NO: 24931 - DNA, 20 bp, Artificial Sequence
  Description of Artificial Sequence: Synthetic oligonucleotide
ttttcctactttgtttcttc

SEQ ID NO: 24932 - DNA, 20 bp, Artificial Sequence
  Description of Artificial Sequence: Synthetic oligonucleotide
tttttcctactttgtttctt

SEQ ID NO: 24933 - DNA, 20 bp, Artificial Sequence
  Description of Artificial Sequence: Synthetic oligonucleotide
ctttttcctactttgtttct

SEQ ID NO: 24934 - DNA, 20 bp, Artificial Sequence
  Description of Artificial Sequence: Synthetic oligonucleotide
actttttcctactttgtttc

SEQ ID NO: 24935 - DNA, 20 bp, Artificial Sequence
  Description of Artificial Sequence: Synthetic oligonucleotide
cactttttcctactttgttt

SEQ ID NO: 24936 - DNA, 20 bp, Artificial Sequence
  Description of Artificial Sequence: Synthetic oligonucleotide
tcactttttcctactttgtt

SEQ ID NO: 24937 - DNA, 20 bp, Artificial Sequence
  Description of Artificial Sequence: Synthetic oligonucleotide
ttcactttttcctactttgt

SEQ ID NO: 24938 - DNA, 20 bp, Artificial Sequence
  Description of Artificial Sequence: Synthetic oligonucleotide
gttcactttttcctactttg

SEQ ID NO: 24939 - DNA, 20 bp, Artificial Sequence
  Description of Artificial Sequence: Synthetic oligonucleotide
tgttcactttttcctacttt

SEQ ID NO: 24940 - DNA, 20 bp, Artificial Sequence
  Description of Artificial Sequence: Synthetic oligonucleotide
ctgttcactttttcctactt

SEQ ID NO: 24941 - DNA, 20 bp, Artificial Sequence
  Description of Artificial Sequence: Synthetic oligonucleotide
cctgttcactttttcctact

SEQ ID NO: 24942 - DNA, 20 bp, Artificial Sequence
  Description of Artificial Sequence: Synthetic oligonucleotide
ccctgttcactttttcctac

SEQ ID NO: 24943 - DNA, 20 bp, Artificial Sequence
  Description of Artificial Sequence: Synthetic oligonucleotide
cccctgttcactttttccta

SEQ ID NO: 24944 - DNA, 20 bp, Artificial Sequence
  Description of Artificial Sequence: Synthetic oligonucleotide
tcccctgttcactttttcct

SEQ ID NO: 24945 - DNA, 20 bp, Artificial Sequence
  Description of Artificial Sequence: Synthetic oligonucleotide
atcccctgttcactttttcc

SEQ ID NO: 24946 - DNA, 20 bp, Artificial Sequence
  Description of Artificial Sequence: Synthetic oligonucleotide
catcccctgttcactttttc

SEQ ID NO: 24947 - DNA, 20 bp, Artificial Sequence
  Description of Artificial Sequence: Synthetic oligonucleotide
acatcccctgttcacttttt

SEQ ID NO: 24948 - DNA, 20 bp, Artificial Sequence
  Description of Artificial Sequence: Synthetic oligonucleotide
gacatcccctgttcactttt

SEQ ID NO: 24949 - DNA, 20 bp, Artificial Sequence
  Description of Artificial Sequence: Synthetic oligonucleotide
tgacatcccctgttcacttt

SEQ ID NO: 24950 - DNA, 20 bp, Artificial Sequence
  Description of Artificial Sequence: Synthetic oligonucleotide
ttgacatcccctgttcactt

SEQ ID NO: 24951 - DNA, 20 bp, Artificial Sequence
  Description of Artificial Sequence: Synthetic oligonucleotide
tttgacatcccctgttcact

SEQ ID NO: 24952 - DNA, 20 bp, Artificial Sequence
  Description of Artificial Sequence: Synthetic oligonucleotide
atttgacatcccctgttcac

SEQ ID NO: 24953 - DNA, 20 bp, Artificial Sequence
  Description of Artificial Sequence: Synthetic oligonucleotide
gatttgacatcccctgttca

SEQ ID NO: 24954 - DNA, 20 bp, Artificial Sequence
  Description of Artificial Sequence: Synthetic oligonucleotide
cgatttgacatcccctgttc

SEQ ID NO: 24955 - DNA, 20 bp, Artificial Sequence
  Description of Artificial Sequence: Synthetic oligonucleotide
tcgatttgacatcccctgtt

SEQ ID NO: 24956 - DNA, 20 bp, Artificial Sequence
  Description of Artificial Sequence: Synthetic oligonucleotide
atcgatttgacatcccctgt

SEQ ID NO: 24957 - DNA, 20 bp, Artificial Sequence
  Description of Artificial Sequence: Synthetic oligonucleotide
aatcgatttgacatcccctg

SEQ ID NO: 24958 - DNA, 20 bp, Artificial Sequence
  Description of Artificial Sequence: Synthetic oligonucleotide
gaatcgatttgacatcccct

SEQ ID NO: 24959 - DNA, 20 bp, Artificial Sequence
  Description of Artificial Sequence: Synthetic oligonucleotide
agaatcgatttgacatcccc

SEQ ID NO: 24960 - DNA, 20 bp, Artificial Sequence
  Description of Artificial Sequence: Synthetic oligonucleotide
aagaatcgatttgacatccc

SEQ ID NO: 24961 - DNA, 20 bp, Artificial Sequence
  Description of Artificial Sequence: Synthetic oligonucleotide
caagaatcgatttgacatcc

SEQ ID NO: 24962 - DNA, 20 bp, Artificial Sequence
  Description of Artificial Sequence: Synthetic oligonucleotide
tcaagaatcgatttgacatc

SEQ ID NO: 24963 - DNA, 20 bp, Artificial Sequence
  Description of Artificial Sequence: Synthetic oligonucleotide
ttcaagaatcgatttgacat

SEQ ID NO: 24964 - DNA, 20 bp, Artificial Sequence
  Description of Artificial Sequence: Synthetic oligonucleotide
attcaagaatcgatttgaca

SEQ ID NO: 24965 - DNA, 20 bp, Artificial Sequence
  Description of Artificial Sequence: Synthetic oligonucleotide
aattcaagaatcgatttgac

SEQ ID NO: 24966 - DNA, 20 bp, Artificial Sequence
  Description of Artificial Sequence: Synthetic oligonucleotide
gaattcaagaatcgatttga

SEQ ID NO: 24967 - DNA, 20 bp, Artificial Sequence
  Description of Artificial Sequence: Synthetic oligonucleotide
ggaattcaagaatcgatttg

SEQ ID NO: 24968 - DNA, 20 bp, Artificial Sequence
  Description of Artificial Sequence: Synthetic oligonucleotide
gggaattcaagaatcgattt

SEQ ID NO: 24969 - DNA, 20 bp, Artificial Sequence
  Description of Artificial Sequence: Synthetic oligonucleotide
cgggaattcaagaatcgatt

SEQ ID NO: 24970 - DNA, 20 bp, Artificial Sequence
  Description of Artificial Sequence: Synthetic oligonucleotide
gcgggaattcaagaatcgat

SEQ ID NO: 24971 - DNA, 20 bp, Artificial Sequence
  Description of Artificial Sequence: Synthetic oligonucleotide
agcgggaattcaagaatcga

SEQ ID NO: 24972 - DNA, 20 bp, Artificial Sequence
  Description of Artificial Sequence: Synthetic oligonucleotide
cagcgggaattcaagaatcg

SEQ ID NO: 24973 - DNA, 20 bp, Artificial Sequence
  Description of Artificial Sequence: Synthetic oligonucleotide
gcagcgggaattcaagaatc

SEQ ID NO: 24974 - DNA, 20 bp, Artificial Sequence
  Description of Artificial Sequence: Synthetic oligonucleotide
tgcagcgggaattcaagaat

SEQ ID NO: 24975 - DNA, 20 bp, Artificial Sequence
  Description of Artificial Sequence: Synthetic oligonucleotide
ttgcagcgggaattcaagaa

SEQ ID NO: 24976 - DNA, 20 bp, Artificial Sequence
  Description of Artificial Sequence: Synthetic oligonucleotide
cttgcagcgggaattcaaga

SEQ ID NO: 24977 - DNA, 20 bp, Artificial Sequence
  Description of Artificial Sequence: Synthetic oligonucleotide
gcttgcagcgggaattcaag

SEQ ID NO: 24978 - DNA, 20 bp, Artificial Sequence
  Description of Artificial Sequence: Synthetic oligonucleotide
agcttgcagcgggaattcaa

SEQ ID NO: 24979 - DNA, 20 bp, Artificial Sequence
  Description of Artificial Sequence: Synthetic oligonucleotide
tagcttgcagcgggaattca

SEQ ID NO: 24980 - DNA, 20 bp, Artificial Sequence
  Description of Artificial Sequence: Synthetic oligonucleotide
ctagcttgcagcgggaattc

SEQ ID NO: 24981 - DNA, 20 bp, Artificial Sequence
  Description of Artificial Sequence: Synthetic oligonucleotide
tctagcttgcagcgggaatt

SEQ ID NO: 24982 - DNA, 20 bp, Artificial Sequence
  Description of Artificial Sequence: Synthetic oligonucleotide
ctctagcttgcagcgggaat

SEQ ID NO: 24983 - DNA, 20 bp, Artificial Sequence
  Description of Artificial Sequence: Synthetic oligonucleotide
gctctagcttgcagcgggaa

SEQ ID NO: 24984 - DNA, 20 bp, Artificial Sequence
  Description of Artificial Sequence: Synthetic oligonucleotide
ggctctagcttgcagcggga

SEQ ID NO: 24985 - DNA, 20 bp, Artificial Sequence
  Description of Artificial Sequence: Synthetic oligonucleotide
cggctctagcttgcagcggg

SEQ ID NO: 24986 - DNA, 20 bp, Artificial Sequence
  Description of Artificial Sequence: Synthetic oligonucleotide
gcggctctagcttgcagcgg

SEQ ID NO: 24987 - DNA, 20 bp, Artificial Sequence
  Description of Artificial Sequence: Synthetic oligonucleotide
tgcggctctagcttgcagcg

SEQ ID NO: 24988 - DNA, 20 bp, Artificial Sequence
  Description of Artificial Sequence: Synthetic oligonucleotide
ctgcggctctagcttgcagc

SEQ ID NO: 24989 - DNA, 20 bp, Artificial Sequence
  Description of Artificial Sequence: Synthetic oligonucleotide
cctgcggctctagcttgcag

SEQ ID NO: 24990 - DNA, 20 bp, Artificial Sequence
  Description of Artificial Sequence: Synthetic oligonucleotide
gcctgcggctctagcttgca

SEQ ID NO: 24991 - DNA, 20 bp, Artificial Sequence
  Description of Artificial Sequence: Synthetic oligonucleotide
tgcctgcggctctagcttgc

SEQ ID NO: 24992 - DNA, 20 bp, Artificial Sequence
  Description of Artificial Sequence: Synthetic oligonucleotide
gtgcctgcggctctagcttg

SEQ ID NO: 24993 - DNA, 20 bp, Artificial Sequence
  Description of Artificial Sequence: Synthetic oligonucleotide
ggtgcctgcggctctagctt

SEQ ID NO: 24994 - DNA, 20 bp, Artificial Sequence
  Description of Artificial Sequence: Synthetic oligonucleotide
gggtgcctgcggctctagct

SEQ ID NO: 24995 - DNA, 20 bp, Artificial Sequence
  Description of Artificial Sequence: Synthetic oligonucleotide
agggtgcctgcggctctagc

SEQ ID NO: 24996 - DNA, 20 bp, Artificial Sequence
  Description of Artificial Sequence: Synthetic oligonucleotide
gagggtgcctgcggctctag

SEQ ID NO: 24997 - DNA, 20 bp, Artificial Sequence
  Description of Artificial Sequence: Synthetic oligonucleotide
agagggtgcctgcggctcta

SEQ ID NO: 24998 - DNA, 20 bp, Artificial Sequence
  Description of Artificial Sequence: Synthetic oligonucleotide
gagagggtgcctgcggctct

SEQ ID NO: 24999 - DNA, 20 bp, Artificial Sequence
  Description of Artificial Sequence: Synthetic oligonucleotide
tgagagggtgcctgcggctc

SEQ ID NO: 25000 - DNA, 20 bp, Artificial Sequence
  Description of Artificial Sequence: Synthetic oligonucleotide
gtgagagggtgcctgcggct

SEQ ID NO: 25001 - DNA, 20 bp, Artificial Sequence
  Description of Artificial Sequence: Synthetic oligonucleotide
agtgagagggtgcctgcggc

SEQ ID NO: 25002 - DNA, 20 bp, Artificial Sequence
  Description of Artificial Sequence: Synthetic oligonucleotide
gagtgagagggtgcctgcgg

SEQ ID NO: 25003 - DNA, 20 bp, Artificial Sequence
  Description of Artificial Sequence: Synthetic oligonucleotide
tgagtgagagggtgcctgcg

SEQ ID NO: 25004 - DNA, 20 bp, Artificial Sequence
  Description of Artificial Sequence: Synthetic oligonucleotide
ttgagtgagagggtgcctgc

SEQ ID NO: 25005 - DNA, 20 bp, Artificial Sequence
  Description of Artificial Sequence: Synthetic oligonucleotide
attgagtgagagggtgcctg

SEQ ID NO: 25006 - DNA, 20 bp, Artificial Sequence
  Description of Artificial Sequence: Synthetic oligonucleotide
aattgagtgagagggtgcct

SEQ ID NO: 25007 - DNA, 20 bp, Artificial Sequence
  Description of Artificial Sequence: Synthetic oligonucleotide
aaattgagtgagagggtgcc

SEQ ID NO: 25008 - DNA, 20 bp, Artificial Sequence
  Description of Artificial Sequence: Synthetic oligonucleotide
gaaattgagtgagagggtgc

SEQ ID NO: 25009 - DNA, 20 bp, Artificial Sequence
  Description of Artificial Sequence: Synthetic oligonucleotide
ggaaattgagtgagagggtg

SEQ ID NO: 25010 - DNA, 20 bp, Artificial Sequence
  Description of Artificial Sequence: Synthetic oligonucleotide
tggaaattgagtgagagggt

SEQ ID NO: 25011 - DNA, 20 bp, Artificial Sequence
  Description of Artificial Sequence: Synthetic oligonucleotide
gtggaaattgagtgagaggg

SEQ ID NO: 25012 - DNA, 20 bp, Artificial Sequence
  Description of Artificial Sequence: Synthetic oligonucleotide
agtggaaattgagtgagagg

SEQ ID NO: 25013 - DNA, 20 bp, Artificial Sequence
  Description of Artificial Sequence: Synthetic oligonucleotide
gagtggaaattgagtgagag

SEQ ID NO: 25014 - DNA, 20 bp, Artificial Sequence
  Description of Artificial Sequence: Synthetic oligonucleotide
tgagtggaaattgagtgaga

SEQ ID NO: 25015 - DNA, 20 bp, Artificial Sequence
  Description of Artificial Sequence: Synthetic oligonucleotide
ctgagtggaaattgagtgag

SEQ ID NO: 25016 - DNA, 20 bp, Artificial Sequence
  Description of Artificial Sequence: Synthetic oligonucleotide
tctgagtggaaattgagtga

SEQ ID NO: 25017 - DNA, 20 bp, Artificial Sequence
  Description of Artificial Sequence: Synthetic oligonucleotide
ttctgagtggaaattgagtg

SEQ ID NO: 25018 - DNA, 20 bp, Artificial Sequence
  Description of Artificial Sequence: Synthetic oligonucleotide
gttctgagtggaaattgagt

SEQ ID NO: 25019 - DNA, 20 bp, Artificial Sequence
  Description of Artificial Sequence: Synthetic oligonucleotide
ggttctgagtggaaattgag

SEQ ID NO: 25020 - DNA, 20 bp, Artificial Sequence
  Description of Artificial Sequence: Synthetic oligonucleotide
gggttctgagtggaaattga

SEQ ID NO: 25021 - DNA, 20 bp, Artificial Sequence
  Description of Artificial Sequence: Synthetic oligonucleotide
agggttctgagtggaaattg

SEQ ID NO: 25022 - DNA, 20 bp, Artificial Sequence
  Description of Artificial Sequence: Synthetic oligonucleotide
tagggttctgagtggaaatt

SEQ ID NO: 25023 - DNA, 20 bp, Artificial Sequence
  Description of Artificial Sequence: Synthetic oligonucleotide
atagggttctgagtggaaat

SEQ ID NO: 25024 - DNA, 20 bp, Artificial Sequence
  Description of Artificial Sequence: Synthetic oligonucleotide
tatagggttctgagtggaaa

SEQ ID NO: 25025 - DNA, 20 bp, Artificial Sequence
  Description of Artificial Sequence: Synthetic oligonucleotide
ttatagggttctgagtggaa

SEQ ID NO: 25026 - DNA, 20 bp, Artificial Sequence
  Description of Artificial Sequence: Synthetic oligonucleotide
tttatagggttctgagtgga

SEQ ID NO: 25027 - DNA, 20 bp, Artificial Sequence
  Description of Artificial Sequence: Synthetic oligonucleotide
gtttatagggttctgagtgg

SEQ ID NO: 25028 - DNA, 20 bp, Artificial Sequence
  Description of Artificial Sequence: Synthetic oligonucleotide
tgtttatagggttctgagtg

SEQ ID NO: 25029 - DNA, 20 bp, Artificial Sequence
  Description of Artificial Sequence: Synthetic oligonucleotide
gtgtttatagggttctgagt

SEQ ID NO: 25030 - DNA, 20 bp, Artificial Sequence
  Description of Artificial Sequence: Synthetic oligonucleotide
ggtgtttatagggttctgag

SEQ ID NO: 25031 - DNA, 20 bp, Artificial Sequence
  Description of Artificial Sequence: Synthetic oligonucleotide
tggtgtttatagggttctga

SEQ ID NO: 25032 - DNA, 20 bp, Artificial Sequence
  Description of Artificial Sequence: Synthetic oligonucleotide
ctggtgtttatagggttctg

SEQ ID NO: 25033 - DNA, 20 bp, Artificial Sequence
  Description of Artificial Sequence: Synthetic oligonucleotide
actggtgtttatagggttct

SEQ ID NO: 25034 - DNA, 20 bp, Artificial Sequence
  Description of Artificial Sequence: Synthetic oligonucleotide
cactggtgtttatagggttc

SEQ ID NO: 25035 - DNA, 20 bp, Artificial Sequence
  Description of Artificial Sequence: Synthetic oligonucleotide
ccactggtgtttatagggtt

SEQ ID NO: 25036 - DNA, 20 bp, Artificial Sequence
  Description of Artificial Sequence: Synthetic oligonucleotide
cccactggtgtttatagggt

SEQ ID NO: 25037 - DNA, 20 bp, Artificial Sequence
  Description of Artificial Sequence: Synthetic oligonucleotide
tcccactggtgtttataggg

SEQ ID NO: 25038 - DNA, 20 bp, Artificial Sequence
  Description of Artificial Sequence: Synthetic oligonucleotide
ttcccactggtgtttatagg

SEQ ID NO: 25039 - DNA, 20 bp, Artificial Sequence
  Description of Artificial Sequence: Synthetic oligonucleotide
cttcccactggtgtttatag

SEQ ID NO: 25040 - DNA, 20 bp, Artificial Sequence
  Description of Artificial Sequence: Synthetic oligonucleotide
ccttcccactggtgtttata

SEQ ID NO: 25041 - DNA, 20 bp, Artificial Sequence
  Description of Artificial Sequence: Synthetic oligonucleotide
cccttcccactggtgtttat

SEQ ID NO: 25042 - DNA, 20 bp, Artificial Sequence
  Description of Artificial Sequence: Synthetic oligonucleotide
gcccttcccactggtgttta

SEQ ID NO: 25043 - DNA, 20 bp, Artificial Sequence
  Description of Artificial Sequence: Synthetic oligonucleotide
tgcccttcccactggtgttt

SEQ ID NO: 25044 - DNA, 20 bp, Artificial Sequence
  Description of Artificial Sequence: Synthetic oligonucleotide
ttgcccttcccactggtgtt

SEQ ID NO: 25045 - DNA, 20 bp, Artificial Sequence
  Description of Artificial Sequence: Synthetic oligonucleotide
gttgcccttcccactggtgt

SEQ ID NO: 25046 - DNA, 20 bp, Artificial Sequence
  Description of Artificial Sequence: Synthetic oligonucleotide
ggttgcccttcccactggtg

SEQ ID NO: 25047 - DNA, 20 bp, Artificial Sequence
  Description of Artificial Sequence: Synthetic oligonucleotide
gggttgcccttcccactggt

SEQ ID NO: 25048 - DNA, 20 bp, Artificial Sequence
  Description of Artificial Sequence: Synthetic oligonucleotide
tgggttgcccttcccactgg

SEQ ID NO: 25049 - DNA, 20 bp, Artificial Sequence
  Description of Artificial Sequence: Synthetic oligonucleotide
gtgggttgcccttcccactg

SEQ ID NO: 25050 - DNA, 20 bp, Artificial Sequence
  Description of Artificial Sequence: Synthetic oligonucleotide
agtgggttgcccttcccact

SEQ ID NO: 25051 - DNA, 20 bp, Artificial Sequence
  Description of Artificial Sequence: Synthetic oligonucleotide
cagtgggttgcccttcccac

SEQ ID NO: 25052 - DNA, 20 bp, Artificial Sequence
  Description of Artificial Sequence: Synthetic oligonucleotide
gcagtgggttgcccttccca

SEQ ID NO: 25053 - DNA, 20 bp, Artificial Sequence
  Description of Artificial Sequence: Synthetic oligonucleotide
tgcagtgggttgcccttccc

SEQ ID NO: 25054 - DNA, 20 bp, Artificial Sequence
  Description of Artificial Sequence: Synthetic oligonucleotide
gtgcagtgggttgcccttcc

SEQ ID NO: 25055 - DNA, 20 bp, Artificial Sequence
  Description of Artificial Sequence: Synthetic oligonucleotide
cgtgcagtgggttgcccttc

SEQ ID NO: 25056 - DNA, 20 bp, Artificial Sequence
  Description of Artificial Sequence: Synthetic oligonucleotide
acgtgcagtgggttgccctt

SEQ ID NO: 25057 - DNA, 20 bp, Artificial Sequence
  Description of Artificial Sequence: Synthetic oligonucleotide
cacgtgcagtgggttgccct

SEQ ID NO: 25058 - DNA, 20 bp, Artificial Sequence
  Description of Artificial Sequence: Synthetic oligonucleotide
ccacgtgcagtgggttgccc

SEQ ID NO: 25059 - DNA, 20 bp, Artificial Sequence
  Description of Artificial Sequence: Synthetic oligonucleotide
cccacgtgcagtgggttgcc

SEQ ID NO: 25060 - DNA, 20 bp, Artificial Sequence
  Description of Artificial Sequence: Synthetic oligonucleotide
tcccacgtgcagtgggttgc

SEQ ID NO: 25061 - DNA, 20 bp, Artificial Sequence
  Description of Artificial Sequence: Synthetic oligonucleotide
ttcccacgtgcagtgggttg

SEQ ID NO: 25062 - DNA, 20 bp, Artificial Sequence
  Description of Artificial Sequence: Synthetic oligonucleotide
attcccacgtgcagtgggtt

SEQ ID NO: 25063 - DNA, 20 bp, Artificial Sequence
  Description of Artificial Sequence: Synthetic oligonucleotide
cattcccacgtgcagtgggt

SEQ ID NO: 25064 - DNA, 20 bp, Artificial Sequence
  Description of Artificial Sequence: Synthetic oligonucleotide
gcattcccacgtgcagtggg

SEQ ID NO: 25065 - DNA, 20 bp, Artificial Sequence
  Description of Artificial Sequence: Synthetic oligonucleotide
tgcattcccacgtgcagtgg

SEQ ID NO: 25066 - DNA, 20 bp, Artificial Sequence
  Description of Artificial Sequence: Synthetic oligonucleotide
gtgcattcccacgtgcagtg

SEQ ID NO: 25067 - DNA, 20 bp, Artificial Sequence
  Description of Artificial Sequence: Synthetic oligonucleotide
agtgcattcccacgtgcagt

SEQ ID NO: 25068 - DNA, 20 bp, Artificial Sequence
  Description of Artificial Sequence: Synthetic oligonucleotide
cagtgcattcccacgtgcag

SEQ ID NO: 25069 - DNA, 20 bp, Artificial Sequence
  Description of Artificial Sequence: Synthetic oligonucleotide
tcagtgcattcccacgtgca

SEQ ID NO: 25070 - DNA, 20 bp, Artificial Sequence
  Description of Artificial Sequence: Synthetic oligonucleotide
atcagtgcattcccacgtgc

SEQ ID NO: 25071 - DNA, 20 bp, Artificial Sequence
  Description of Artificial Sequence: Synthetic oligonucleotide
aatcagtgcattcccacgtg

SEQ ID NO: 25072 - DNA, 20 bp, Artificial Sequence
  Description of Artificial Sequence: Synthetic oligonucleotide
aaatcagtgcattcccacgt

SEQ ID NO: 25073 - DNA, 20 bp, Artificial Sequence
  Description of Artificial Sequence: Synthetic oligonucleotide
aaaatcagtgcattcccacg

SEQ ID NO: 25074 - DNA, 20 bp, Artificial Sequence
  Description of Artificial Sequence: Synthetic oligonucleotide
aaaaatcagtgcattcccac

SEQ ID NO: 25075 - DNA, 20 bp, Artificial Sequence
  Description of Artificial Sequence: Synthetic oligonucleotide
gaaaaatcagtgcattccca

SEQ ID NO: 25076 - DNA, 20 bp, Artificial Sequence
  Description of Artificial Sequence: Synthetic oligonucleotide
ggaaaaatcagtgcattccc

SEQ ID NO: 25077 - DNA, 20 bp, Artificial Sequence
  Description of Artificial Sequence: Synthetic oligonucleotide
aggaaaaatcagtgcattcc

SEQ ID NO: 25078 - DNA, 20 bp, Artificial Sequence
  Description of Artificial Sequence: Synthetic oligonucleotide
taggaaaaatcagtgcattc

SEQ ID NO: 25079 - DNA, 20 bp, Artificial Sequence
  Description of Artificial Sequence: Synthetic oligonucleotide
ctaggaaaaatcagtgcatt

SEQ ID NO: 25080 - DNA, 20 bp, Artificial Sequence
  Description of Artificial Sequence: Synthetic oligonucleotide
cctaggaaaaatcagtgcat

SEQ ID NO: 25081 - DNA, 20 bp, Artificial Sequence
  Description of Artificial Sequence: Synthetic oligonucleotide
tcctaggaaaaatcagtgca

SEQ ID NO: 25082 - DNA, 20 bp, Artificial Sequence
  Description of Artificial Sequence: Synthetic oligonucleotide
ctcctaggaaaaatcagtgc

SEQ ID NO: 25083 - DNA, 20 bp, Artificial Sequence
  Description of Artificial Sequence: Synthetic oligonucleotide
actcctaggaaaaatcagtg

SEQ ID NO: 25084 - DNA, 20 bp, Artificial Sequence
  Description of Artificial Sequence: Synthetic oligonucleotide
tactcctaggaaaaatcagt

SEQ ID NO: 25085 - DNA, 20 bp, Artificial Sequence
  Description of Artificial Sequence: Synthetic oligonucleotide
ctactcctaggaaaaatcag

SEQ ID NO: 25086 - DNA, 20 bp, Artificial Sequence
  Description of Artificial Sequence: Synthetic oligonucleotide
tctactcctaggaaaaatca

SEQ ID NO: 25087 - DNA, 20 bp, Artificial Sequence
  Description of Artificial Sequence: Synthetic oligonucleotide
gtctactcctaggaaaaatc

SEQ ID NO: 25088 - DNA, 20 bp, Artificial Sequence
  Description of Artificial Sequence: Synthetic oligonucleotide
tgtctactcctaggaaaaat

SEQ ID NO: 25089 - DNA, 20 bp, Artificial Sequence
  Description of Artificial Sequence: Synthetic oligonucleotide
atgtctactcctaggaaaaa

SEQ ID NO: 25090 - DNA, 20 bp, Artificial Sequence
  Description of Artificial Sequence: Synthetic oligonucleotide
catgtctactcctaggaaaa

SEQ ID NO: 25091 - DNA, 20 bp, Artificial Sequence
  Description of Artificial Sequence: Synthetic oligonucleotide
acatgtctactcctaggaaa

SEQ ID NO: 25092 - DNA, 20 bp, Artificial Sequence
  Description of Artificial Sequence: Synthetic oligonucleotide
aacatgtctactcctaggaa

SEQ ID NO: 25093 - DNA, 20 bp, Artificial Sequence
  Description of Artificial Sequence: Synthetic oligonucleotide
gaacatgtctactcctagga

SEQ ID NO: 25094 - DNA, 20 bp, Artificial Sequence
  Description of Artificial Sequence: Synthetic oligonucleotide
ggaacatgtctactcctagg

SEQ ID NO: 25095 - DNA, 20 bp, Artificial Sequence
  Description of Artificial Sequence: Synthetic oligonucleotide
aggaacatgtctactcctag

SEQ ID NO: 25096 - DNA, 20 bp, Artificial Sequence
  Description of Artificial Sequence: Synthetic oligonucleotide
gaggaacatgtctactccta

SEQ ID NO: 25097 - DNA, 20 bp, Artificial Sequence
  Description of Artificial Sequence: Synthetic oligonucleotide
agaggaacatgtctactcct

SEQ ID NO: 25098 - DNA, 20 bp, Artificial Sequence
  Description of Artificial Sequence: Synthetic oligonucleotide
tagaggaacatgtctactcc

SEQ ID NO: 25099 - DNA, 20 bp, Artificial Sequence
  Description of Artificial Sequence: Synthetic oligonucleotide
ttagaggaacatgtctactc

SEQ ID NO: 25100 - DNA, 20 bp, Artificial Sequence
  Description of Artificial Sequence: Synthetic oligonucleotide
attagaggaacatgtctact

SEQ ID NO: 25101 - DNA, 20 bp, Artificial Sequence
  Description of Artificial Sequence: Synthetic oligonucleotide
aattagaggaacatgtctac

SEQ ID NO: 25102 - DNA, 20 bp, Artificial Sequence
  Description of Artificial Sequence: Synthetic oligonucleotide
taattagaggaacatgtcta

SEQ ID NO: 25103 - DNA, 20 bp, Artificial Sequence
  Description of Artificial Sequence: Synthetic oligonucleotide
gtaattagaggaacatgtct

SEQ ID NO: 25104 - DNA, 20 bp, Artificial Sequence
  Description of Artificial Sequence: Synthetic oligonucleotide
agtaattagaggaacatgtc

SEQ ID NO: 25105 - DNA, 20 bp, Artificial Sequence
  Description of Artificial Sequence: Synthetic oligonucleotide
gagtaattagaggaacatgt

SEQ ID NO: 25106 - DNA, 20 bp, Artificial Sequence
  Description of Artificial Sequence: Synthetic oligonucleotide
ggagtaattagaggaacatg

SEQ ID NO: 25107 - DNA, 20 bp, Artificial Sequence
  Description of Artificial Sequence: Synthetic oligonucleotide
gggagtaattagaggaacat

SEQ ID NO: 25108 - DNA, 20 bp, Artificial Sequence
  Description of Artificial Sequence: Synthetic oligonucleotide
agggagtaattagaggaaca

SEQ ID NO: 25109 - DNA, 20 bp, Artificial Sequence
  Description of Artificial Sequence: Synthetic oligonucleotide
cagggagtaattagaggaac

SEQ ID NO: 25110 - DNA, 20 bp, Artificial Sequence
  Description of Artificial Sequence: Synthetic oligonucleotide
tcagggagtaattagaggaa

SEQ ID NO: 25111 - DNA, 20 bp, Artificial Sequence
  Description of Artificial Sequence: Synthetic oligonucleotide
ctcagggagtaattagagga

SEQ ID NO: 25112 - DNA, 20 bp, Artificial Sequence
  Description of Artificial Sequence: Synthetic oligonucleotide
cctcagggagtaattagagg

SEQ ID NO: 25113 - DNA, 20 bp, Artificial Sequence
  Description of Artificial Sequence: Synthetic oligonucleotide
ccctcagggagtaattagag

SEQ ID NO: 25114 - DNA, 20 bp, Artificial Sequence
  Description of Artificial Sequence: Synthetic oligonucleotide
accctcagggagtaattaga

SEQ ID NO: 25115 - DNA, 20 bp, Artificial Sequence
  Description of Artificial Sequence: Synthetic oligonucleotide
aaccctcagggagtaattag

SEQ ID NO: 25116 - DNA, 20 bp, Artificial Sequence
  Description of Artificial Sequence: Synthetic oligonucleotide
taaccctcagggagtaatta

SEQ ID NO: 25117 - DNA, 20 bp, Artificial Sequence
  Description of Artificial Sequence: Synthetic oligonucleotide
ctaaccctcagggagtaatt

SEQ ID NO: 25118 - DNA, 20 bp, Artificial Sequence
  Description of Artificial Sequence: Synthetic oligonucleotide
actaaccctcagggagtaat

SEQ ID NO: 25119 - DNA, 20 bp, Artificial Sequence
  Description of Artificial Sequence: Synthetic oligonucleotide
aactaaccctcagggagtaa

SEQ ID NO: 25120 - DNA, 20 bp, Artificial Sequence
  Description of Artificial Sequence: Synthetic oligonucleotide
caactaaccctcagggagta

SEQ ID NO: 25121 - DNA, 20 bp, Artificial Sequence
  Description of Artificial Sequence: Synthetic oligonucleotide
ccaactaaccctcagggagt

SEQ ID NO: 25122 - DNA, 20 bp, Artificial Sequence
  Description of Artificial Sequence: Synthetic oligonucleotide
cccaactaaccctcagggag

SEQ ID NO: 25123 - DNA, 20 bp, Artificial Sequence
  Description of Artificial Sequence: Synthetic oligonucleotide
ccccaactaaccctcaggga

SEQ ID NO: 25124 - DNA, 20 bp, Artificial Sequence
  Description of Artificial Sequence: Synthetic oligonucleotide
gccccaactaaccctcaggg

SEQ ID NO: 25125 - DNA, 20 bp, Artificial Sequence
  Description of Artificial Sequence: Synthetic oligonucleotide
agccccaactaaccctcagg

SEQ ID NO: 25126 - DNA, 20 bp, Artificial Sequence
  Description of Artificial Sequence: Synthetic oligonucleotide
tagccccaactaaccctcag

SEQ ID NO: 25127 - DNA, 20 bp, Artificial Sequence
  Description of Artificial Sequence: Synthetic oligonucleotide
ttagccccaactaaccctca

SEQ ID NO: 25128 - DNA, 20 bp, Artificial Sequence
  Description of Artificial Sequence: Synthetic oligonucleotide
tttagccccaactaaccctc

SEQ ID NO: 25129 - DNA, 20 bp, Artificial Sequence
  Description of Artificial Sequence: Synthetic oligonucleotide
gtttagccccaactaaccct

SEQ ID NO: 25130 - DNA, 20 bp, Artificial Sequence
  Description of Artificial Sequence: Synthetic oligonucleotide
ggtttagccccaactaaccc

SEQ ID NO: 25131 - DNA, 20 bp, Artificial Sequence
  Description of Artificial Sequence: Synthetic oligonucleotide
tggtttagccccaactaacc

SEQ ID NO: 25132 - DNA, 20 bp, Artificial Sequence
  Description of Artificial Sequence: Synthetic oligonucleotide
atggtttagccccaactaac

SEQ ID NO: 25133 - DNA, 20 bp, Artificial Sequence
  Description of Artificial Sequence: Synthetic oligonucleotide
catggtttagccccaactaa

SEQ ID NO: 25134 - DNA, 20 bp, Artificial Sequence
  Description of Artificial Sequence: Synthetic oligonucleotide
tcatggtttagccccaacta

SEQ ID NO: 25135 - DNA, 20 bp, Artificial Sequence
  Description of Artificial Sequence: Synthetic oligonucleotide
gtcatggtttagccccaact

SEQ ID NO: 25136 - DNA, 20 bp, Artificial Sequence
  Description of Artificial Sequence: Synthetic oligonucleotide
tgtcatggtttagccccaac

SEQ ID NO: 25137 - DNA, 20 bp, Artificial Sequence
  Description of Artificial Sequence: Synthetic oligonucleotide
ctgtcatggtttagccccaa

SEQ ID NO: 25138 - DNA, 20 bp, Artificial Sequence
  Description of Artificial Sequence: Synthetic oligonucleotide
tctgtcatggtttagcccca

SEQ ID NO: 25139 - DNA, 20 bp, Artificial Sequence
  Description of Artificial Sequence: Synthetic oligonucleotide
ttctgtcatggtttagcccc

SEQ ID NO: 25140 - DNA, 20 bp, Artificial Sequence
  Description of Artificial Sequence: Synthetic oligonucleotide
cttctgtcatggtttagccc

SEQ ID NO: 25141 - DNA, 20 bp, Artificial Sequence
  Description of Artificial Sequence: Synthetic oligonucleotide
acttctgtcatggtttagcc

SEQ ID NO: 25142 - DNA, 20 bp, Artificial Sequence
  Description of Artificial Sequence: Synthetic oligonucleotide
cacttctgtcatggtttagc

SEQ ID NO: 25143 - DNA, 20 bp, Artificial Sequence
  Description of Artificial Sequence: Synthetic oligonucleotide
ccacttctgtcatggtttag

SEQ ID NO: 25144 - DNA, 20 bp, Artificial Sequence
  Description of Artificial Sequence: Synthetic oligonucleotide
cccacttctgtcatggttta

SEQ ID NO: 25145 - DNA, 20 bp, Artificial Sequence
  Description of Artificial Sequence: Synthetic oligonucleotide
ccccacttctgtcatggttt

SEQ ID NO: 25146 - DNA, 20 bp, Artificial Sequence
  Description of Artificial Sequence: Synthetic oligonucleotide
tccccacttctgtcatggtt

SEQ ID NO: 25147 - DNA, 20 bp, Artificial Sequence
  Description of Artificial Sequence: Synthetic oligonucleotide
ttccccacttctgtcatggt

SEQ ID NO: 25148 - DNA, 20 bp, Artificial Sequence
  Description of Artificial Sequence: Synthetic oligonucleotide
cttccccacttctgtcatgg

SEQ ID NO: 25149 - DNA, 20 bp, Artificial Sequence
  Description of Artificial Sequence: Synthetic oligonucleotide
acttccccacttctgtcatg

SEQ ID NO: 25150 - DNA, 20 bp, Artificial Sequence
  Description of Artificial Sequence: Synthetic oligonucleotide
aacttccccacttctgtcat

SEQ ID NO: 25151 - DNA, 20 bp, Artificial Sequence
  Description of Artificial Sequence: Synthetic oligonucleotide
gaacttccccacttctgtca

SEQ ID NO: 25152 - DNA, 20 bp, Artificial Sequence
  Description of Artificial Sequence: Synthetic oligonucleotide
tgaacttccccacttctgtc

SEQ ID NO: 25153 - DNA, 20 bp, Artificial Sequence
  Description of Artificial Sequence: Synthetic oligonucleotide
ttgaacttccccacttctgt

SEQ ID NO: 25154 - DNA, 20 bp, Artificial Sequence
  Description of Artificial Sequence: Synthetic oligonucleotide
attgaacttccccacttctg

SEQ ID NO: 25155 - DNA, 20 bp, Artificial Sequence
  Description of Artificial Sequence: Synthetic oligonucleotide
cattgaacttccccacttct

SEQ ID NO: 25156 - DNA, 20 bp, Artificial Sequence
  Description of Artificial Sequence: Synthetic oligonucleotide
acattgaacttccccacttc

SEQ ID NO: 25157 - DNA, 20 bp, Artificial Sequence
  Description of Artificial Sequence: Synthetic oligonucleotide
gacattgaacttccccactt

SEQ ID NO: 25158 - DNA, 20 bp, Artificial Sequence
  Description of Artificial Sequence: Synthetic oligonucleotide
ggacattgaacttccccact

SEQ ID NO: 25159 - DNA, 20 bp, Artificial Sequence
  Description of Artificial Sequence: Synthetic oligonucleotide
aggacattgaacttccccac

SEQ ID NO: 25160 - DNA, 20 bp, Artificial Sequence
  Description of Artificial Sequence: Synthetic oligonucleotide
aaggacattgaacttcccca

SEQ ID NO: 25161 - DNA, 20 bp, Artificial Sequence
  Description of Artificial Sequence: Synthetic oligonucleotide
taaggacattgaacttcccc

SEQ ID NO: 25162 - DNA, 20 bp, Artificial Sequence
  Description of Artificial Sequence: Synthetic oligonucleotide
ttaaggacattgaacttccc

SEQ ID NO: 25163 - DNA, 20 bp, Artificial Sequence
  Description of Artificial Sequence: Synthetic oligonucleotide
tttaaggacattgaacttcc

SEQ ID NO: 25164 - DNA, 20 bp, Artificial Sequence
  Description of Artificial Sequence: Synthetic oligonucleotide
atttaaggacattgaacttc

SEQ ID NO: 25165 - DNA, 20 bp, Artificial Sequence
  Description of Artificial Sequence: Synthetic oligonucleotide
gatttaaggacattgaactt

SEQ ID NO: 25166 - DNA, 20 bp, Artificial Sequence
  Description of Artificial Sequence: Synthetic oligonucleotide
ggatttaaggacattgaact

SEQ ID NO: 25167 - DNA, 20 bp, Artificial Sequence
  Description of Artificial Sequence: Synthetic oligonucleotide
tggatttaaggacattgaac

SEQ ID NO: 25168 - DNA, 20 bp, Artificial Sequence
  Description of Artificial Sequence: Synthetic oligonucleotide
atggatttaaggacattgaa

SEQ ID NO: 25169 - DNA, 20 bp, Artificial Sequence
  Description of Artificial Sequence: Synthetic oligonucleotide
gatggatttaaggacattga

SEQ ID NO: 25170 - DNA, 20 bp, Artificial Sequence
  Description of Artificial Sequence: Synthetic oligonucleotide
agatggatttaaggacattg

SEQ ID NO: 25171 - DNA, 20 bp, Artificial Sequence
  Description of Artificial Sequence: Synthetic oligonucleotide
aagatggatttaaggacatt

SEQ ID NO: 25172 - DNA, 20 bp, Artificial Sequence
  Description of Artificial Sequence: Synthetic oligonucleotide
taagatggatttaaggacat

SEQ ID NO: 25173 - DNA, 20 bp, Artificial Sequence
  Description of Artificial Sequence: Synthetic oligonucleotide
gtaagatggatttaaggaca

SEQ ID NO: 25174 - DNA, 20 bp, Artificial Sequence
  Description of Artificial Sequence: Synthetic oligonucleotide
agtaagatggatttaaggac

SEQ ID NO: 25175 - DNA, 20 bp, Artificial Sequence
  Description of Artificial Sequence: Synthetic oligonucleotide
aagtaagatggatttaagga

SEQ ID NO: 25176 - DNA, 20 bp, Artificial Sequence
  Description of Artificial Sequence: Synthetic oligonucleotide
caagtaagatggatttaagg

SEQ ID NO: 25177 - DNA, 20 bp, Artificial Sequence
  Description of Artificial Sequence: Synthetic oligonucleotide
gcaagtaagatggatttaag

SEQ ID NO: 25178 - DNA, 20 bp, Artificial Sequence
  Description of Artificial Sequence: Synthetic oligonucleotide
ggcaagtaagatggatttaa

SEQ ID NO: 25179 - DNA, 20 bp, Artificial Sequence
  Description of Artificial Sequence: Synthetic oligonucleotide
tggcaagtaagatggattta

SEQ ID NO: 25180 - DNA, 20 bp, Artificial Sequence
  Description of Artificial Sequence: Synthetic oligonucleotide
ttggcaagtaagatggattt

SEQ ID NO: 25181 - DNA, 20 bp, Artificial Sequence
  Description of Artificial Sequence: Synthetic oligonucleotide
gttggcaagtaagatggatt

SEQ ID NO: 25182 - DNA, 20 bp, Artificial Sequence
  Description of Artificial Sequence: Synthetic oligonucleotide
tgttggcaagtaagatggat

SEQ ID NO: 25183 - DNA, 20 bp, Artificial Sequence
  Description of Artificial Sequence: Synthetic oligonucleotide
ctgttggcaagtaagatgga

SEQ ID NO: 25184 - DNA, 20 bp, Artificial Sequence
  Description of Artificial Sequence: Synthetic oligonucleotide
cctgttggcaagtaagatgg

SEQ ID NO: 25185 - DNA, 20 bp, Artificial Sequence
  Description of Artificial Sequence: Synthetic oligonucleotide
acctgttggcaagtaagatg

SEQ ID NO: 25186 - DNA, 20 bp, Artificial Sequence
  Description of Artificial Sequence: Synthetic oligonucleotide
tacctgttggcaagtaagat

SEQ ID NO: 25187 - DNA, 20 bp, Artificial Sequence
  Description of Artificial Sequence: Synthetic oligonucleotide
ttacctgttggcaagtaaga

SEQ ID NO: 25188 - DNA, 20 bp, Artificial Sequence
  Description of Artificial Sequence: Synthetic oligonucleotide
cttacctgttggcaagtaag

SEQ ID NO: 25189 - DNA, 20 bp, Artificial Sequence
  Description of Artificial Sequence: Synthetic oligonucleotide
tcttacctgttggcaagtaa

SEQ ID NO: 25190 - DNA, 20 bp, Artificial Sequence
  Description of Artificial Sequence: Synthetic oligonucleotide
ctcttacctgttggcaagta

SEQ ID NO: 25191 - DNA, 20 bp, Artificial Sequence
  Description of Artificial Sequence: Synthetic oligonucleotide
cctcttacctgttggcaagt

SEQ ID NO: 25192 - DNA, 20 bp, Artificial Sequence
  Description of Artificial Sequence: Synthetic oligonucleotide
tcctcttacctgttggcaag

SEQ ID NO: 25193 - DNA, 20 bp, Artificial Sequence
  Description of Artificial Sequence: Synthetic oligonucleotide
ttcctcttacctgttggcaa

SEQ ID NO: 25194 - DNA, 20 bp, Artificial Sequence
  Description of Artificial Sequence: Synthetic oligonucleotide
cttcctcttacctgttggca

SEQ ID NO: 25195 - DNA, 20 bp, Artificial Sequence
  Description of Artificial Sequence: Synthetic oligonucleotide
gcttcctcttacctgttggc

SEQ ID NO: 25196 - DNA, 20 bp, Artificial Sequence
  Description of Artificial Sequence: Synthetic oligonucleotide
agcttcctcttacctgttgg

SEQ ID NO: 25197 - DNA, 20 bp, Artificial Sequence
  Description of Artificial Sequence: Synthetic oligonucleotide
aagcttcctcttacctgttg

SEQ ID NO: 25198 - DNA, 20 bp, Artificial Sequence
  Description of Artificial Sequence: Synthetic oligonucleotide
taagcttcctcttacctgtt

SEQ ID NO: 25199 - DNA, 20 bp, Artificial Sequence
  Description of Artificial Sequence: Synthetic oligonucleotide
gtaagcttcctcttacctgt

SEQ ID NO: 25200 - DNA, 20 bp, Artificial Sequence
  Description of Artificial Sequence: Synthetic oligonucleotide
tgtaagcttcctcttacctg

SEQ ID NO: 25201 - DNA, 20 bp, Artificial Sequence
  Description of Artificial Sequence: Synthetic oligonucleotide
atgtaagcttcctcttacct

SEQ ID NO: 25202 - DNA, 20 bp, Artificial Sequence
  Description of Artificial Sequence: Synthetic oligonucleotide
aatgtaagcttcctcttacc

SEQ ID NO: 25203 - DNA, 20 bp, Artificial Sequence
  Description of Artificial Sequence: Synthetic oligonucleotide
taatgtaagcttcctcttac

SEQ ID NO: 25204 - DNA, 20 bp, Artificial Sequence
  Description of Artificial Sequence: Synthetic oligonucleotide
gtaatgtaagcttcctctta

SEQ ID NO: 25205 - DNA, 20 bp, Artificial Sequence
  Description of Artificial Sequence: Synthetic oligonucleotide
tgtaatgtaagcttcctctt

SEQ ID NO: 25206 - DNA, 20 bp, Artificial Sequence
  Description of Artificial Sequence: Synthetic oligonucleotide
atgtaatgtaagcttcctct

SEQ ID NO: 25207 - DNA, 20 bp, Artificial Sequence
  Description of Artificial Sequence: Synthetic oligonucleotide
catgtaatgtaagcttcctc

SEQ ID NO: 25208 - DNA, 20 bp, Artificial Sequence
  Description of Artificial Sequence: Synthetic oligonucleotide
acatgtaatgtaagcttcct

SEQ ID NO: 25209 - DNA, 20 bp, Artificial Sequence
  Description of Artificial Sequence: Synthetic oligonucleotide
gacatgtaatgtaagcttcc

SEQ ID NO: 25210 - DNA, 20 bp, Artificial Sequence
  Description of Artificial Sequence: Synthetic oligonucleotide
ggacatgtaatgtaagcttc

SEQ ID NO: 25211 - DNA, 20 bp, Artificial Sequence
  Description of Artificial Sequence: Synthetic oligonucleotide
tggacatgtaatgtaagctt

SEQ ID NO: 25212 - DNA, 20 bp, Artificial Sequence
  Description of Artificial Sequence: Synthetic oligonucleotide
ctggacatgtaatgtaagct

SEQ ID NO: 25213 - DNA, 20 bp, Artificial Sequence
  Description of Artificial Sequence: Synthetic oligonucleotide
actggacatgtaatgtaagc

SEQ ID NO: 25214 - DNA, 20 bp, Artificial Sequence
  Description of Artificial Sequence: Synthetic oligonucleotide
gactggacatgtaatgtaag

SEQ ID NO: 25215 - DNA, 20 bp, Artificial Sequence
  Description of Artificial Sequence: Synthetic oligonucleotide
ggactggacatgtaatgtaa

SEQ ID NO: 25216 - DNA, 20 bp, Artificial Sequence
  Description of Artificial Sequence: Synthetic oligonucleotide
tggactggacatgtaatgta

SEQ ID NO: 25217 - DNA, 20 bp, Artificial Sequence
  Description of Artificial Sequence: Synthetic oligonucleotide
gtggactggacatgtaatgt

SEQ ID NO: 25218 - DNA, 20 bp, Artificial Sequence
  Description of Artificial Sequence: Synthetic oligonucleotide
tgtggactggacatgtaatg

SEQ ID NO: 25219 - DNA, 20 bp, Artificial Sequence
  Description of Artificial Sequence: Synthetic oligonucleotide
atgtggactggacatgtaat

SEQ ID NO: 25220 - DNA, 20 bp, Artificial Sequence
  Description of Artificial Sequence: Synthetic oligonucleotide
aatgtggactggacatgtaa

SEQ ID NO: 25221 - DNA, 20 bp, Artificial Sequence
  Description of Artificial Sequence: Synthetic oligonucleotide
aaatgtggactggacatgta

SEQ ID NO: 25222 - DNA, 20 bp, Artificial Sequence
  Description of Artificial Sequence: Synthetic oligonucleotide
taaatgtggactggacatgt

SEQ ID NO: 25223 - DNA, 20 bp, Artificial Sequence
  Description of Artificial Sequence: Synthetic oligonucleotide
ttaaatgtggactggacatg

SEQ ID NO: 25224 - DNA, 20 bp, Artificial Sequence
  Description of Artificial Sequence: Synthetic oligonucleotide
tttaaatgtggactggacat

SEQ ID NO: 25225 - DNA, 20 bp, Artificial Sequence
  Description of Artificial Sequence: Synthetic oligonucleotide
ctttaaatgtggactggaca

SEQ ID NO: 25226 - DNA, 20 bp, Artificial Sequence
  Description of Artificial Sequence: Synthetic oligonucleotide
tctttaaatgtggactggac

SEQ ID NO: 25227 - DNA, 20 bp, Artificial Sequence
  Description of Artificial Sequence: Synthetic oligonucleotide
ctctttaaatgtggactgga

SEQ ID NO: 25228 - DNA, 20 bp, Artificial Sequence
  Description of Artificial Sequence: Synthetic oligonucleotide
gctctttaaatgtggactgg

SEQ ID NO: 25229 - DNA, 20 bp, Artificial Sequence
  Description of Artificial Sequence: Synthetic oligonucleotide
tgctctttaaatgtggactg

SEQ ID NO: 25230 - DNA, 20 bp, Artificial Sequence
  Description of Artificial Sequence: Synthetic oligonucleotide
gtgctctttaaatgtggact

SEQ ID NO: 25231 - DNA, 20 bp, Artificial Sequence
  Description of Artificial Sequence: Synthetic oligonucleotide
agtgctctttaaatgtggac

SEQ ID NO: 25232 - DNA, 20 bp, Artificial Sequence
  Description of Artificial Sequence: Synthetic oligonucleotide
aagtgctctttaaatgtgga

SEQ ID NO: 25233 - DNA, 20 bp, Artificial Sequence
  Description of Artificial Sequence: Synthetic oligonucleotide
taagtgctctttaaatgtgg

SEQ ID NO: 25234 - DNA, 20 bp, Artificial Sequence
  Description of Artificial Sequence: Synthetic oligonucleotide
gtaagtgctctttaaatgtg

SEQ ID NO: 25235 - DNA, 20 bp, Artificial Sequence
  Description of Artificial Sequence: Synthetic oligonucleotide
agtaagtgctctttaaatgt

SEQ ID NO: 25236 - DNA, 20 bp, Artificial Sequence
  Description of Artificial Sequence: Synthetic oligonucleotide
cagtaagtgctctttaaatg

SEQ ID NO: 25237 - DNA, 20 bp, Artificial Sequence
  Description of Artificial Sequence: Synthetic oligonucleotide
acagtaagtgctctttaaat

SEQ ID NO: 25238 - DNA, 20 bp, Artificial Sequence
  Description of Artificial Sequence: Synthetic oligonucleotide
cacagtaagtgctctttaaa

SEQ ID NO: 25239 - DNA, 20 bp, Artificial Sequence
  Description of Artificial Sequence: Synthetic oligonucleotide
ccacagtaagtgctctttaa

SEQ ID NO: 25240 - DNA, 20 bp, Artificial Sequence
  Description of Artificial Sequence: Synthetic oligonucleotide
tccacagtaagtgctcttta

SEQ ID NO: 25241 - DNA, 20 bp, Artificial Sequence
  Description of Artificial Sequence: Synthetic oligonucleotide
ttccacagtaagtgctcttt

SEQ ID NO: 25242 - DNA, 20 bp, Artificial Sequence
  Description of Artificial Sequence: Synthetic oligonucleotide
gttccacagtaagtgctctt

SEQ ID NO: 25243 - DNA, 20 bp, Artificial Sequence
  Description of Artificial Sequence: Synthetic oligonucleotide
tgttccacagtaagtgctct

SEQ ID NO: 25244 - DNA, 20 bp, Artificial Sequence
  Description of Artificial Sequence: Synthetic oligonucleotide
ttgttccacagtaagtgctc

SEQ ID NO: 25245 - DNA, 20 bp, Artificial Sequence
  Description of Artificial Sequence: Synthetic oligonucleotide
cttgttccacagtaagtgct

SEQ ID NO: 25246 - DNA, 20 bp, Artificial Sequence
  Description of Artificial Sequence: Synthetic oligonucleotide
gcttgttccacagtaagtgc

SEQ ID NO: 25247 - DNA, 20 bp, Artificial Sequence
  Description of Artificial Sequence: Synthetic oligonucleotide
ggcttgttccacagtaagtg

SEQ ID NO: 25248 - DNA, 20 bp, Artificial Sequence
  Description of Artificial Sequence: Synthetic oligonucleotide
aggcttgttccacagtaagt

SEQ ID NO: 25249 - DNA, 20 bp, Artificial Sequence
  Description of Artificial Sequence: Synthetic oligonucleotide
aaggcttgttccacagtaag

SEQ ID NO: 25250 - DNA, 20 bp, Artificial Sequence
  Description of Artificial Sequence: Synthetic oligonucleotide
gaaggcttgttccacagtaa

SEQ ID NO: 25251 - DNA, 20 bp, Artificial Sequence
  Description of Artificial Sequence: Synthetic oligonucleotide
tgaaggcttgttccacagta

SEQ ID NO: 25252 - DNA, 20 bp, Artificial Sequence
  Description of Artificial Sequence: Synthetic oligonucleotide
ctgaaggcttgttccacagt

SEQ ID NO: 25253 - DNA, 20 bp, Artificial Sequence
  Description of Artificial Sequence: Synthetic oligonucleotide
gctgaaggcttgttccacag

SEQ ID NO: 25254 - DNA, 20 bp, Artificial Sequence
  Description of Artificial Sequence: Synthetic oligonucleotide
ggctgaaggcttgttccaca

SEQ ID NO: 25255 - DNA, 20 bp, Artificial Sequence
  Description of Artificial Sequence: Synthetic oligonucleotide
tggctgaaggcttgttccac

SEQ ID NO: 25256 - DNA, 20 bp, Artificial Sequence
  Description of Artificial Sequence: Synthetic oligonucleotide
ttggctgaaggcttgttcca

SEQ ID NO: 25257 - DNA, 20 bp, Artificial Sequence
  Description of Artificial Sequence: Synthetic oligonucleotide
tttggctgaaggcttgttcc

SEQ ID NO: 25258 - DNA, 20 bp, Artificial Sequence
  Description of Artificial Sequence: Synthetic oligonucleotide
gtttggctgaaggcttgttc

SEQ ID NO: 25259 - DNA, 20 bp, Artificial Sequence
  Description of Artificial Sequence: Synthetic oligonucleotide
tgtttggctgaaggcttgtt

SEQ ID NO: 25260 - DNA, 20 bp, Artificial Sequence
  Description of Artificial Sequence: Synthetic oligonucleotide
ttgtttggctgaaggcttgt

SEQ ID NO: 25261 - DNA, 20 bp, Artificial Sequence
  Description of Artificial Sequence: Synthetic oligonucleotide
attgtttggctgaaggcttg

SEQ ID NO: 25262 - DNA, 20 bp, Artificial Sequence
  Description of Artificial Sequence: Synthetic oligonucleotide
cattgtttggctgaaggctt

SEQ ID NO: 25263 - DNA, 20 bp, Artificial Sequence
  Description of Artificial Sequence: Synthetic oligonucleotide
ccattgtttggctgaaggct

SEQ ID NO: 25264 - DNA, 20 bp, Artificial Sequence
  Description of Artificial Sequence: Synthetic oligonucleotide
cccattgtttggctgaaggc

SEQ ID NO: 25265 - DNA, 20 bp, Artificial Sequence
  Description of Artificial Sequence: Synthetic oligonucleotide
ccccattgtttggctgaagg

SEQ ID NO: 25266 - DNA, 20 bp, Artificial Sequence
  Description of Artificial Sequence: Synthetic oligonucleotide
tccccattgtttggctgaag

SEQ ID NO: 25267 - DNA, 20 bp, Artificial Sequence
  Description of Artificial Sequence: Synthetic oligonucleotide
atccccattgtttggctgaa

SEQ ID NO: 25268 - DNA, 20 bp, Artificial Sequence
  Description of Artificial Sequence: Synthetic oligonucleotide
tatccccattgtttggctga

SEQ ID NO: 25269 - DNA, 20 bp, Artificial Sequence
  Description of Artificial Sequence: Synthetic oligonucleotide
ctatccccattgtttggctg

SEQ ID NO: 25270 - DNA, 20 bp, Artificial Sequence
  Description of Artificial Sequence: Synthetic oligonucleotide
tctatccccattgtttggct

SEQ ID NO: 25271 - DNA, 20 bp, Artificial Sequence
  Description of Artificial Sequence: Synthetic oligonucleotide
ttctatccccattgtttggc

SEQ ID NO: 25272 - DNA, 20 bp, Artificial Sequence
  Description of Artificial Sequence: Synthetic oligonucleotide
tttctatccccattgtttgg

SEQ ID NO: 25273 - DNA, 20 bp, Artificial Sequence
  Description of Artificial Sequence: Synthetic oligonucleotide
ttttctatccccattgtttg

SEQ ID NO: 25274 - DNA, 20 bp, Artificial Sequence
  Description of Artificial Sequence: Synthetic oligonucleotide
cttttctatccccattgttt

SEQ ID NO: 25275 - DNA, 20 bp, Artificial Sequence
  Description of Artificial Sequence: Synthetic oligonucleotide
acttttctatccccattgtt

SEQ ID NO: 25276 - DNA, 20 bp, Artificial Sequence
  Description of Artificial Sequence: Synthetic oligonucleotide
tacttttctatccccattgt

SEQ ID NO: 25277 - DNA, 20 bp, Artificial Sequence
  Description of Artificial Sequence: Synthetic oligonucleotide
ctacttttctatccccattg

SEQ ID NO: 25278 - DNA, 20 bp, Artificial Sequence
  Description of Artificial Sequence: Synthetic oligonucleotide
cctacttttctatccccatt

SEQ ID NO: 25279 - DNA, 20 bp, Artificial Sequence
  Description of Artificial Sequence: Synthetic oligonucleotide
acctacttttctatccccat

SEQ ID NO: 25280 - DNA, 20 bp, Artificial Sequence
  Description of Artificial Sequence: Synthetic oligonucleotide
tacctacttttctatcccca

SEQ ID NO: 25281 - DNA, 20 bp, Artificial Sequence
  Description of Artificial Sequence: Synthetic oligonucleotide
ttacctacttttctatcccc

SEQ ID NO: 25282 - DNA, 20 bp, Artificial Sequence
  Description of Artificial Sequence: Synthetic oligonucleotide
cttacctacttttctatccc

SEQ ID NO: 25283 - DNA, 20 bp, Artificial Sequence
  Description of Artificial Sequence: Synthetic oligonucleotide
tcttacctacttttctatcc

SEQ ID NO: 25284 - DNA, 20 bp, Artificial Sequence
  Description of Artificial Sequence: Synthetic oligonucleotide
gtcttacctacttttctatc

SEQ ID NO: 25285 - DNA, 20 bp, Artificial Sequence
  Description of Artificial Sequence: Synthetic oligonucleotide
agtcttacctacttttctat

SEQ ID NO: 25286 - DNA, 20 bp, Artificial Sequence
  Description of Artificial Sequence: Synthetic oligonucleotide
gagtcttacctacttttcta

SEQ ID NO: 25287 - DNA, 20 bp, Artificial Sequence
  Description of Artificial Sequence: Synthetic oligonucleotide
tgagtcttacctacttttct

SEQ ID NO: 25288 - DNA, 20 bp, Artificial Sequence
  Description of Artificial Sequence: Synthetic oligonucleotide
ctgagtcttacctacttttc

SEQ ID NO: 25289 - DNA, 20 bp, Artificial Sequence
  Description of Artificial Sequence: Synthetic oligonucleotide
gctgagtcttacctactttt

SEQ ID NO: 25290 - DNA, 20 bp, Artificial Sequence
  Description of Artificial Sequence: Synthetic oligonucleotide
ggctgagtcttacctacttt

SEQ ID NO: 25291 - DNA, 20 bp, Artificial Sequence
  Description of Artificial Sequence: Synthetic oligonucleotide
aggctgagtcttacctactt

SEQ ID NO: 25292 - DNA, 20 bp, Artificial Sequence
  Description of Artificial Sequence: Synthetic oligonucleotide
aaggctgagtcttacctact

SEQ ID NO: 25293 - DNA, 20 bp, Artificial Sequence
  Description of Artificial Sequence: Synthetic oligonucleotide
aaaggctgagtcttacctac

SEQ ID NO: 25294 - DNA, 20 bp, Artificial Sequence
  Description of Artificial Sequence: Synthetic oligonucleotide
caaaggctgagtcttaccta

SEQ ID NO: 25295 - DNA, 20 bp, Artificial Sequence
  Description of Artificial Sequence: Synthetic oligonucleotide
acaaaggctgagtcttacct

SEQ ID NO: 25296 - DNA, 20 bp, Artificial Sequence
  Description of Artificial Sequence: Synthetic oligonucleotide
gacaaaggctgagtcttacc

SEQ ID NO: 25297 - DNA, 20 bp, Artificial Sequence
  Description of Artificial Sequence: Synthetic oligonucleotide
ggacaaaggctgagtcttac

SEQ ID NO: 25298 - DNA, 20 bp, Artificial Sequence
  Description of Artificial Sequence: Synthetic oligonucleotide
tggacaaaggctgagtctta

SEQ ID NO: 25299 - DNA, 20 bp, Artificial Sequence
  Description of Artificial Sequence: Synthetic oligonucleotide
ctggacaaaggctgagtctt

SEQ ID NO: 25300 - DNA, 20 bp, Artificial Sequence
  Description of Artificial Sequence: Synthetic oligonucleotide
tctggacaaaggctgagtct

SEQ ID NO: 25301 - DNA, 20 bp, Artificial Sequence
  Description of Artificial Sequence: Synthetic oligonucleotide
ctctggacaaaggctgagtc

SEQ ID NO: 25302 - DNA, 20 bp, Artificial Sequence
  Description of Artificial Sequence: Synthetic oligonucleotide
tctctggacaaaggctgagt

SEQ ID NO: 25303 - DNA, 20 bp, Artificial Sequence
  Description of Artificial Sequence: Synthetic oligonucleotide
ttctctggacaaaggctgag

SEQ ID NO: 25304 - DNA, 20 bp, Artificial Sequence
  Description of Artificial Sequence: Synthetic oligonucleotide
cttctctggacaaaggctga

SEQ ID NO: 25305 - DNA, 20 bp, Artificial Sequence
  Description of Artificial Sequence: Synthetic oligonucleotide
gcttctctggacaaaggctg

SEQ ID NO: 25306 - DNA, 20 bp, Artificial Sequence
  Description of Artificial Sequence: Synthetic oligonucleotide
agcttctctggacaaaggct

SEQ ID NO: 25307 - DNA, 20 bp, Artificial Sequence
  Description of Artificial Sequence: Synthetic oligonucleotide
gagcttctctggacaaaggc

SEQ ID NO: 25308 - DNA, 20 bp, Artificial Sequence
  Description of Artificial Sequence: Synthetic oligonucleotide
tgagcttctctggacaaagg

SEQ ID NO: 25309 - DNA, 20 bp, Artificial Sequence
  Description of Artificial Sequence: Synthetic oligonucleotide
ctgagcttctctggacaaag

SEQ ID NO: 25310 - DNA, 20 bp, Artificial Sequence
  Description of Artificial Sequence: Synthetic oligonucleotide
cctgagcttctctggacaaa

SEQ ID NO: 25311 - DNA, 20 bp, Artificial Sequence
  Description of Artificial Sequence: Synthetic oligonucleotide
ccctgagcttctctggacaa

SEQ ID NO: 25312 - DNA, 20 bp, Artificial Sequence
  Description of Artificial Sequence: Synthetic oligonucleotide
accctgagcttctctggaca

SEQ ID NO: 25313 - DNA, 20 bp, Artificial Sequence
  Description of Artificial Sequence: Synthetic oligonucleotide
taccctgagcttctctggac

SEQ ID NO: 25314 - DNA, 20 bp, Artificial Sequence
  Description of Artificial Sequence: Synthetic oligonucleotide
ataccctgagcttctctgga

SEQ ID NO: 25315 - DNA, 20 bp, Artificial Sequence
  Description of Artificial Sequence: Synthetic oligonucleotide
tataccctgagcttctctgg

SEQ ID NO: 25316 - DNA, 20 bp, Artificial Sequence
  Description of Artificial Sequence: Synthetic oligonucleotide
ctataccctgagcttctctg

SEQ ID NO: 25317 - DNA, 20 bp, Artificial Sequence
  Description of Artificial Sequence: Synthetic oligonucleotide
gctataccctgagcttctct

SEQ ID NO: 25318 - DNA, 20 bp, Artificial Sequence
  Description of Artificial Sequence: Synthetic oligonucleotide
agctataccctgagcttctc

SEQ ID NO: 25319 - DNA, 20 bp, Artificial Sequence
  Description of Artificial Sequence: Synthetic oligonucleotide
cagctataccctgagcttct

SEQ ID NO: 25320 - DNA, 20 bp, Artificial Sequence
  Description of Artificial Sequence: Synthetic oligonucleotide
tcagctataccctgagcttc

SEQ ID NO: 25321 - DNA, 20 bp, Artificial Sequence
  Description of Artificial Sequence: Synthetic oligonucleotide
ttcagctataccctgagctt

SEQ ID NO: 25322 - DNA, 20 bp, Artificial Sequence
  Description of Artificial Sequence: Synthetic oligonucleotide
attcagctataccctgagct

SEQ ID NO: 25323 - DNA, 20 bp, Artificial Sequence
  Description of Artificial Sequence: Synthetic oligonucleotide
tattcagctataccctgagc

SEQ ID NO: 25324 - DNA, 20 bp, Artificial Sequence
  Description of Artificial Sequence: Synthetic oligonucleotide
ctattcagctataccctgag

SEQ ID NO: 25325 - DNA, 20 bp, Artificial Sequence
  Description of Artificial Sequence: Synthetic oligonucleotide
cctattcagctataccctga

SEQ ID NO: 25326 - DNA, 20 bp, Artificial Sequence
  Description of Artificial Sequence: Synthetic oligonucleotide
gcctattcagctataccctg

SEQ ID NO: 25327 - DNA, 20 bp, Artificial Sequence
  Description of Artificial Sequence: Synthetic oligonucleotide
tgcctattcagctataccct

SEQ ID NO: 25328 - DNA, 20 bp, Artificial Sequence
  Description of Artificial Sequence: Synthetic oligonucleotide
ctgcctattcagctataccc

SEQ ID NO: 25329 - DNA, 20 bp, Artificial Sequence
  Description of Artificial Sequence: Synthetic oligonucleotide
actgcctattcagctatacc

SEQ ID NO: 25330 - DNA, 20 bp, Artificial Sequence
  Description of Artificial Sequence: Synthetic oligonucleotide
aactgcctattcagctatac

SEQ ID NO: 25331 - DNA, 20 bp, Artificial Sequence
  Description of Artificial Sequence: Synthetic oligonucleotide
aaactgcctattcagctata

SEQ ID NO: 25332 - DNA, 20 bp, Artificial Sequence
  Description of Artificial Sequence: Synthetic oligonucleotide
gaaactgcctattcagctat

SEQ ID NO: 25333 - DNA, 20 bp, Artificial Sequence
  Description of Artificial Sequence: Synthetic oligonucleotide
agaaactgcctattcagcta

SEQ ID NO: 25334 - DNA, 20 bp, Artificial Sequence
  Description of Artificial Sequence: Synthetic oligonucleotide
aagaaactgcctattcagct

SEQ ID NO: 25335 - DNA, 20 bp, Artificial Sequence
  Description of Artificial Sequence: Synthetic oligonucleotide
aaagaaactgcctattcagc

SEQ ID NO: 25336 - DNA, 20 bp, Artificial Sequence
  Description of Artificial Sequence: Synthetic oligonucleotide
aaaagaaactgcctattcag

SEQ ID NO: 25337 - DNA, 20 bp, Artificial Sequence
  Description of Artificial Sequence: Synthetic oligonucleotide
caaaagaaactgcctattca

SEQ ID NO: 25338 - DNA, 20 bp, Artificial Sequence
  Description of Artificial Sequence: Synthetic oligonucleotide
acaaaagaaactgcctattc

SEQ ID NO: 25339 - DNA, 20 bp, Artificial Sequence
  Description of Artificial Sequence: Synthetic oligonucleotide
gacaaaagaaactgcctatt

SEQ ID NO: 25340 - DNA, 20 bp, Artificial Sequence
  Description of Artificial Sequence: Synthetic oligonucleotide
ggacaaaagaaactgcctat

SEQ ID NO: 25341 - DNA, 20 bp, Artificial Sequence
  Description of Artificial Sequence: Synthetic oligonucleotide
aggacaaaagaaactgccta

SEQ ID NO: 25342 - DNA, 20 bp, Artificial Sequence
  Description of Artificial Sequence: Synthetic oligonucleotide
caggacaaaagaaactgcct

SEQ ID NO: 25343 - DNA, 20 bp, Artificial Sequence
  Description of Artificial Sequence: Synthetic oligonucleotide
tcaggacaaaagaaactgcc

SEQ ID NO: 25344 - DNA, 20 bp, Artificial Sequence
  Description of Artificial Sequence: Synthetic oligonucleotide
ctcaggacaaaagaaactgc

SEQ ID NO: 25345 - DNA, 20 bp, Artificial Sequence
  Description of Artificial Sequence: Synthetic oligonucleotide
cctcaggacaaaagaaactg

SEQ ID NO: 25346 - DNA, 20 bp, Artificial Sequence
  Description of Artificial Sequence: Synthetic oligonucleotide
tcctcaggacaaaagaaact

SEQ ID NO: 25347 - DNA, 20 bp, Artificial Sequence
  Description of Artificial Sequence: Synthetic oligonucleotide
ttcctcaggacaaaagaaac

SEQ ID NO: 25348 - DNA, 20 bp, Artificial Sequence
  Description of Artificial Sequence: Synthetic oligonucleotide
tttcctcaggacaaaagaaa

SEQ ID NO: 25349 - DNA, 20 bp, Artificial Sequence
  Description of Artificial Sequence: Synthetic oligonucleotide
ttttcctcaggacaaaagaa

SEQ ID NO: 25350 - DNA, 20 bp, Artificial Sequence
  Description of Artificial Sequence: Synthetic oligonucleotide
attttcctcaggacaaaaga

SEQ ID NO: 25351 - DNA, 20 bp, Artificial Sequence
  Description of Artificial Sequence: Synthetic oligonucleotide
gattttcctcaggacaaaag

SEQ ID NO: 25352 - DNA, 20 bp, Artificial Sequence
  Description of Artificial Sequence: Synthetic oligonucleotide
tgattttcctcaggacaaaa

SEQ ID NO: 25353 - DNA, 20 bp, Artificial Sequence
  Description of Artificial Sequence: Synthetic oligonucleotide
ctgattttcctcaggacaaa

SEQ ID NO: 25354 - DNA, 20 bp, Artificial Sequence
  Description of Artificial Sequence: Synthetic oligonucleotide
cctgattttcctcaggacaa

SEQ ID NO: 25355 - DNA, 20 bp, Artificial Sequence
  Description of Artificial Sequence: Synthetic oligonucleotide
tcctgattttcctcaggaca

SEQ ID NO: 25356 - DNA, 20 bp, Artificial Sequence
  Description of Artificial Sequence: Synthetic oligonucleotide
gtcctgattttcctcaggac

SEQ ID NO: 25357 - DNA, 20 bp, Artificial Sequence
  Description of Artificial Sequence: Synthetic oligonucleotide
tgtcctgattttcctcagga

SEQ ID NO: 25358 - DNA, 20 bp, Artificial Sequence
  Description of Artificial Sequence: Synthetic oligonucleotide
atgtcctgattttcctcagg

SEQ ID NO: 25359 - DNA, 20 bp, Artificial Sequence
  Description of Artificial Sequence: Synthetic oligonucleotide
catgtcctgattttcctcag

SEQ ID NO: 25360 - DNA, 20 bp, Artificial Sequence
  Description of Artificial Sequence: Synthetic oligonucleotide
gcatgtcctgattttcctca

SEQ ID NO: 25361 - DNA, 20 bp, Artificial Sequence
  Description of Artificial Sequence: Synthetic oligonucleotide
ggcatgtcctgattttcctc

SEQ ID NO: 25362 - DNA, 20 bp, Artificial Sequence
  Description of Artificial Sequence: Synthetic oligonucleotide
aggcatgtcctgattttcct

SEQ ID NO: 25363 - DNA, 20 bp, Artificial Sequence
  Description of Artificial Sequence: Synthetic oligonucleotide
caggcatgtcctgattttcc

SEQ ID NO: 25364 - DNA, 20 bp, Artificial Sequence
  Description of Artificial Sequence: Synthetic oligonucleotide
gcaggcatgtcctgattttc

SEQ ID NO: 25365 - DNA, 20 bp, Artificial Sequence
  Description of Artificial Sequence: Synthetic oligonucleotide
agcaggcatgtcctgatttt

SEQ ID NO: 25366 - DNA, 20 bp, Artificial Sequence
  Description of Artificial Sequence: Synthetic oligonucleotide
aagcaggcatgtcctgattt

SEQ ID NO: 25367 - DNA, 20 bp, Artificial Sequence
  Description of Artificial Sequence: Synthetic oligonucleotide
aaagcaggcatgtcctgatt

SEQ ID NO: 25368 - DNA, 20 bp, Artificial Sequence
  Description of Artificial Sequence: Synthetic oligonucleotide
gaaagcaggcatgtcctgat

SEQ ID NO: 25369 - DNA, 20 bp, Artificial Sequence
  Description of Artificial Sequence: Synthetic oligonucleotide
agaaagcaggcatgtcctga

SEQ ID NO: 25370 - DNA, 20 bp, Artificial Sequence
  Description of Artificial Sequence: Synthetic oligonucleotide
tagaaagcaggcatgtcctg

SEQ ID NO: 25371 - DNA, 20 bp, Artificial Sequence
  Description of Artificial Sequence: Synthetic oligonucleotide
ttagaaagcaggcatgtcct

SEQ ID NO: 25372 - DNA, 20 bp, Artificial Sequence
  Description of Artificial Sequence: Synthetic oligonucleotide
tttagaaagcaggcatgtcc

SEQ ID NO: 25373 - DNA, 20 bp, Artificial Sequence
  Description of Artificial Sequence: Synthetic oligonucleotide
ttttagaaagcaggcatgtc

SEQ ID NO: 25374 - DNA, 20 bp, Artificial Sequence
  Description of Artificial Sequence: Synthetic oligonucleotide
tttttagaaagcaggcatgt

SEQ ID NO: 25375 - DNA, 20 bp, Artificial Sequence
  Description of Artificial Sequence: Synthetic oligonucleotide
atttttagaaagcaggcatg

SEQ ID NO: 25376 - DNA, 20 bp, Artificial Sequence
  Description of Artificial Sequence: Synthetic oligonucleotide
gatttttagaaagcaggcat

SEQ ID NO: 25377 - DNA, 20 bp, Artificial Sequence
  Description of Artificial Sequence: Synthetic oligonucleotide
agatttttagaaagcaggca

SEQ ID NO: 25378 - DNA, 20 bp, Artificial Sequence
  Description of Artificial Sequence: Synthetic oligonucleotide
aagatttttagaaagcaggc

SEQ ID NO: 25379 - DNA, 20 bp, Artificial Sequence
  Description of Artificial Sequence: Synthetic oligonucleotide
gaagatttttagaaagcagg

SEQ ID NO: 25380 - DNA, 20 bp, Artificial Sequence
  Description of Artificial Sequence: Synthetic oligonucleotide
ggaagatttttagaaagcag

SEQ ID NO: 25381 - DNA, 20 bp, Artificial Sequence
  Description of Artificial Sequence: Synthetic oligonucleotide
aggaagatttttagaaagca

SEQ ID NO: 25382 - DNA, 20 bp, Artificial Sequence
  Description of Artificial Sequence: Synthetic oligonucleotide
gaggaagatttttagaaagc

SEQ ID NO: 25383 - DNA, 20 bp, Artificial Sequence
  Description of Artificial Sequence: Synthetic oligonucleotide
agaggaagatttttagaaag

SEQ ID NO: 25384 - DNA, 20 bp, Artificial Sequence
  Description of Artificial Sequence: Synthetic oligonucleotide
cagaggaagatttttagaaa

SEQ ID NO: 25385 - DNA, 20 bp, Artificial Sequence
  Description of Artificial Sequence: Synthetic oligonucleotide
tcagaggaagatttttagaa

SEQ ID NO: 25386 - DNA, 20 bp, Artificial Sequence
  Description of Artificial Sequence: Synthetic oligonucleotide
ttcagaggaagatttttaga

SEQ ID NO: 25387 - DNA, 20 bp, Artificial Sequence
  Description of Artificial Sequence: Synthetic oligonucleotide
cttcagaggaagatttttag

SEQ ID NO: 25388 - DNA, 20 bp, Artificial Sequence
  Description of Artificial Sequence: Synthetic oligonucleotide
tcttcagaggaagattttta

SEQ ID NO: 25389 - DNA, 20 bp, Artificial Sequence
  Description of Artificial Sequence: Synthetic oligonucleotide
gtcttcagaggaagattttt

SEQ ID NO: 25390 - DNA, 20 bp, Artificial Sequence
  Description of Artificial Sequence: Synthetic oligonucleotide
ggtcttcagaggaagatttt

SEQ ID NO: 25391 - DNA, 20 bp, Artificial Sequence
  Description of Artificial Sequence: Synthetic oligonucleotide
aggtcttcagaggaagattt

SEQ ID NO: 25392 - DNA, 20 bp, Artificial Sequence
  Description of Artificial Sequence: Synthetic oligonucleotide
caggtcttcagaggaagatt

SEQ ID NO: 25393 - DNA, 20 bp, Artificial Sequence
  Description of Artificial Sequence: Synthetic oligonucleotide
tcaggtcttcagaggaagat

SEQ ID NO: 25394 - DNA, 20 bp, Artificial Sequence
  Description of Artificial Sequence: Synthetic oligonucleotide
gtcaggtcttcagaggaaga

SEQ ID NO: 25395 - DNA, 20 bp, Artificial Sequence
  Description of Artificial Sequence: Synthetic oligonucleotide
ggtcaggtcttcagaggaag

SEQ ID NO: 25396 - DNA, 20 bp, Artificial Sequence
  Description of Artificial Sequence: Synthetic oligonucleotide
gggtcaggtcttcagaggaa

SEQ ID NO: 25397 - DNA, 20 bp, Artificial Sequence
  Description of Artificial Sequence: Synthetic oligonucleotide
tgggtcaggtcttcagagga

SEQ ID NO: 25398 - DNA, 20 bp, Artificial Sequence
  Description of Artificial Sequence: Synthetic oligonucleotide
ttgggtcaggtcttcagagg

SEQ ID NO: 25399 - DNA, 20 bp, Artificial Sequence
  Description of Artificial Sequence: Synthetic oligonucleotide
cttgggtcaggtcttcagag

SEQ ID NO: 25400 - DNA, 20 bp, Artificial Sequence
  Description of Artificial Sequence: Synthetic oligonucleotide
gcttgggtcaggtcttcaga

SEQ ID NO: 25401 - DNA, 20 bp, Artificial Sequence
  Description of Artificial Sequence: Synthetic oligonucleotide
agcttgggtcaggtcttcag

SEQ ID NO: 25402 - DNA, 20 bp, Artificial Sequence
  Description of Artificial Sequence: Synthetic oligonucleotide
gagcttgggtcaggtcttca

SEQ ID NO: 25403 - DNA, 20 bp, Artificial Sequence
  Description of Artificial Sequence: Synthetic oligonucleotide
agagcttgggtcaggtcttc

SEQ ID NO: 25404 - DNA, 20 bp, Artificial Sequence
  Description of Artificial Sequence: Synthetic oligonucleotide
aagagcttgggtcaggtctt

SEQ ID NO: 25405 - DNA, 20 bp, Artificial Sequence
  Description of Artificial Sequence: Synthetic oligonucleotide
taagagcttgggtcaggtct

SEQ ID NO: 25406 - DNA, 20 bp, Artificial Sequence
  Description of Artificial Sequence: Synthetic oligonucleotide
ttaagagcttgggtcaggtc

SEQ ID NO: 25407 - DNA, 20 bp, Artificial Sequence
  Description of Artificial Sequence: Synthetic oligonucleotide
tttaagagcttgggtcaggt

SEQ ID NO: 25408 - DNA, 20 bp, Artificial Sequence
  Description of Artificial Sequence: Synthetic oligonucleotide
atttaagagcttgggtcagg

SEQ ID NO: 25409 - DNA, 20 bp, Artificial Sequence
  Description of Artificial Sequence: Synthetic oligonucleotide
catttaagagcttgggtcag

SEQ ID NO: 25410 - DNA, 20 bp, Artificial Sequence
  Description of Artificial Sequence: Synthetic oligonucleotide
gcatttaagagcttgggtca

SEQ ID NO: 25411 - DNA, 20 bp, Artificial Sequence
  Description of Artificial Sequence: Synthetic oligonucleotide
agcatttaagagcttgggtc

SEQ ID NO: 25412 - DNA, 20 bp, Artificial Sequence
  Description of Artificial Sequence: Synthetic oligonucleotide
tagcatttaagagcttgggt

SEQ ID NO: 25413 - DNA, 20 bp, Artificial Sequence
  Description of Artificial Sequence: Synthetic oligonucleotide
atagcatttaagagcttggg

SEQ ID NO: 25414 - DNA, 20 bp, Artificial Sequence
  Description of Artificial Sequence: Synthetic oligonucleotide
aatagcatttaagagcttgg

SEQ ID NO: 25415 - DNA, 20 bp, Artificial Sequence
  Description of Artificial Sequence: Synthetic oligonucleotide
caatagcatttaagagcttg

SEQ ID NO: 25416 - DNA, 20 bp, Artificial Sequence
  Description of Artificial Sequence: Synthetic oligonucleotide
acaatagcatttaagagctt

SEQ ID NO: 25417 - DNA, 20 bp, Artificial Sequence
  Description of Artificial Sequence: Synthetic oligonucleotide
tacaatagcatttaagagct

SEQ ID NO: 25418 - DNA, 20 bp, Artificial Sequence
  Description of Artificial Sequence: Synthetic oligonucleotide
ttacaatagcatttaagagc

SEQ ID NO: 25419 - DNA, 20 bp, Artificial Sequence
  Description of Artificial Sequence: Synthetic oligonucleotide
cttacaatagcatttaagag

SEQ ID NO: 25420 - DNA, 20 bp, Artificial Sequence
  Description of Artificial Sequence: Synthetic oligonucleotide
tcttacaatagcatttaaga

SEQ ID NO: 25421 - DNA, 20 bp, Artificial Sequence
  Description of Artificial Sequence: Synthetic oligonucleotide
ctcttacaatagcatttaag

SEQ ID NO: 25422 - DNA, 20 bp, Artificial Sequence
  Description of Artificial Sequence: Synthetic oligonucleotide
tctcttacaatagcatttaa

SEQ ID NO: 25423 - DNA, 20 bp, Artificial Sequence
  Description of Artificial Sequence: Synthetic oligonucleotide
ttctcttacaatagcattta

SEQ ID NO: 25424 - DNA, 20 bp, Artificial Sequence
  Description of Artificial Sequence: Synthetic oligonucleotide
tttctcttacaatagcattt

SEQ ID NO: 25425 - DNA, 20 bp, Artificial Sequence
  Description of Artificial Sequence: Synthetic oligonucleotide
atttctcttacaatagcatt

SEQ ID NO: 25426 - DNA, 20 bp, Artificial Sequence
  Description of Artificial Sequence: Synthetic oligonucleotide
aatttctcttacaatagcat

SEQ ID NO: 25427 - DNA, 20 bp, Artificial Sequence
  Description of Artificial Sequence: Synthetic oligonucleotide
aaatttctcttacaatagca

SEQ ID NO: 25428 - DNA, 20 bp, Artificial Sequence
  Description of Artificial Sequence: Synthetic oligonucleotide
gaaatttctcttacaatagc

SEQ ID NO: 25429 - DNA, 20 bp, Artificial Sequence
  Description of Artificial Sequence: Synthetic oligonucleotide
agaaatttctcttacaatag

SEQ ID NO: 25430 - DNA, 20 bp, Artificial Sequence
  Description of Artificial Sequence: Synthetic oligonucleotide
aagaaatttctcttacaata

SEQ ID NO: 25431 - DNA, 20 bp, Artificial Sequence
  Description of Artificial Sequence: Synthetic oligonucleotide
aaagaaatttctcttacaat

SEQ ID NO: 25432 - DNA, 20 bp, Artificial Sequence
  Description of Artificial Sequence: Synthetic oligonucleotide
caaagaaatttctcttacaa

SEQ ID NO: 25433 - DNA, 20 bp, Artificial Sequence
  Description of Artificial Sequence: Synthetic oligonucleotide
acaaagaaatttctcttaca

SEQ ID NO: 25434 - DNA, 20 bp, Artificial Sequence
  Description of Artificial Sequence: Synthetic oligonucleotide
gacaaagaaatttctcttac

SEQ ID NO: 25435 - DNA, 20 bp, Artificial Sequence
  Description of Artificial Sequence: Synthetic oligonucleotide
agacaaagaaatttctctta

SEQ ID NO: 25436 - DNA, 20 bp, Artificial Sequence
  Description of Artificial Sequence: Synthetic oligonucleotide
tagacaaagaaatttctctt

SEQ ID NO: 25437 - DNA, 20 bp, Artificial Sequence
  Description of Artificial Sequence: Synthetic oligonucleotide
atagacaaagaaatttctct

SEQ ID NO: 25438 - DNA, 20 bp, Artificial Sequence
  Description of Artificial Sequence: Synthetic oligonucleotide
aatagacaaagaaatttctc

SEQ ID NO: 25439 - DNA, 20 bp, Artificial Sequence
  Description of Artificial Sequence: Synthetic oligonucleotide
taatagacaaagaaatttct

SEQ ID NO: 25440 - DNA, 20 bp, Artificial Sequence
  Description of Artificial Sequence: Synthetic oligonucleotide
ttaatagacaaagaaatttc

SEQ ID NO: 25441 - DNA, 20 bp, Artificial Sequence
  Description of Artificial Sequence: Synthetic oligonucleotide
gttaatagacaaagaaattt

SEQ ID NO: 25442 - DNA, 20 bp, Artificial Sequence
  Description of Artificial Sequence: Synthetic oligonucleotide
agttaatagacaaagaaatt

SEQ ID NO: 25443 - DNA, 20 bp, Artificial Sequence
  Description of Artificial Sequence: Synthetic oligonucleotide
gagttaatagacaaagaaat

SEQ ID NO: 25444 - DNA, 20 bp, Artificial Sequence
  Description of Artificial Sequence: Synthetic oligonucleotide
ggagttaatagacaaagaaa

SEQ ID NO: 25445 - DNA, 20 bp, Artificial Sequence
  Description of Artificial Sequence: Synthetic oligonucleotide
tggagttaatagacaaagaa

SEQ ID NO: 25446 - DNA, 20 bp, Artificial Sequence
  Description of Artificial Sequence: Synthetic oligonucleotide
atggagttaatagacaaaga

SEQ ID NO: 25447 - DNA, 20 bp, Artificial Sequence
  Description of Artificial Sequence: Synthetic oligonucleotide
aatggagttaatagacaaag

SEQ ID NO: 25448 - DNA, 20 bp, Artificial Sequence
  Description of Artificial Sequence: Synthetic oligonucleotide
aaatggagttaatagacaaa

SEQ ID NO: 25449 - DNA, 20 bp, Artificial Sequence
  Description of Artificial Sequence: Synthetic oligonucleotide
aaaatggagttaatagacaa

SEQ ID NO: 25450 - DNA, 20 bp, Artificial Sequence
  Description of Artificial Sequence: Synthetic oligonucleotide
taaaatggagttaatagaca

SEQ ID NO: 25451 - DNA, 20 bp, Artificial Sequence
  Description of Artificial Sequence: Synthetic oligonucleotide
ctaaaatggagttaatagac

SEQ ID NO: 25452 - DNA, 20 bp, Artificial Sequence
  Description of Artificial Sequence: Synthetic oligonucleotide
actaaaatggagttaataga

SEQ ID NO: 25453 - DNA, 20 bp, Artificial Sequence
  Description of Artificial Sequence: Synthetic oligonucleotide
tactaaaatggagttaatag

SEQ ID NO: 25454 - DNA, 20 bp, Artificial Sequence
  Description of Artificial Sequence: Synthetic oligonucleotide
ctactaaaatggagttaata

SEQ ID NO: 25455 - DNA, 20 bp, Artificial Sequence
  Description of Artificial Sequence: Synthetic oligonucleotide
cctactaaaatggagttaat

SEQ ID NO: 25456 - DNA, 20 bp, Artificial Sequence
  Description of Artificial Sequence: Synthetic oligonucleotide
ccctactaaaatggagttaa

SEQ ID NO: 25457 - DNA, 20 bp, Artificial Sequence
  Description of Artificial Sequence: Synthetic oligonucleotide
tccctactaaaatggagtta

SEQ ID NO: 25458 - DNA, 20 bp, Artificial Sequence
  Description of Artificial Sequence: Synthetic oligonucleotide
atccctactaaaatggagtt

SEQ ID NO: 25459 - DNA, 20 bp, Artificial Sequence
  Description of Artificial Sequence: Synthetic oligonucleotide
aatccctactaaaatggagt

SEQ ID NO: 25460 - DNA, 20 bp, Artificial Sequence
  Description of Artificial Sequence: Synthetic oligonucleotide
gaatccctactaaaatggag

SEQ ID NO: 25461 - DNA, 20 bp, Artificial Sequence
  Description of Artificial Sequence: Synthetic oligonucleotide
tgaatccctactaaaatgga

SEQ ID NO: 25462 - DNA, 20 bp, Artificial Sequence
  Description of Artificial Sequence: Synthetic oligonucleotide
gtgaatccctactaaaatgg

SEQ ID NO: 25463 - DNA, 20 bp, Artificial Sequence
  Description of Artificial Sequence: Synthetic oligonucleotide
agtgaatccctactaaaatg

SEQ ID NO: 25464 - DNA, 20 bp, Artificial Sequence
  Description of Artificial Sequence: Synthetic oligonucleotide
cagtgaatccctactaaaat

SEQ ID NO: 25465 - DNA, 20 bp, Artificial Sequence
  Description of Artificial Sequence: Synthetic oligonucleotide
tcagtgaatccctactaaaa

SEQ ID NO: 25466 - DNA, 20 bp, Artificial Sequence
  Description of Artificial Sequence: Synthetic oligonucleotide
gtcagtgaatccctactaaa

SEQ ID NO: 25467 - DNA, 20 bp, Artificial Sequence
  Description of Artificial Sequence: Synthetic oligonucleotide
agtcagtgaatccctactaa

SEQ ID NO: 25468 - DNA, 20 bp, Artificial Sequence
  Description of Artificial Sequence: Synthetic oligonucleotide
tagtcagtgaatccctacta

SEQ ID NO: 25469 - DNA, 20 bp, Artificial Sequence
  Description of Artificial Sequence: Synthetic oligonucleotide
ctagtcagtgaatccctact

SEQ ID NO: 25470 - DNA, 20 bp, Artificial Sequence
  Description of Artificial Sequence: Synthetic oligonucleotide
tctagtcagtgaatccctac

SEQ ID NO: 25471 - DNA, 20 bp, Artificial Sequence
  Description of Artificial Sequence: Synthetic oligonucleotide
atctagtcagtgaatcccta

SEQ ID NO: 25472 - DNA, 20 bp, Artificial Sequence
  Description of Artificial Sequence: Synthetic oligonucleotide
aatctagtcagtgaatccct

SEQ ID NO: 25473 - DNA, 20 bp, Artificial Sequence
  Description of Artificial Sequence: Synthetic oligonucleotide
aaatctagtcagtgaatccc

SEQ ID NO: 25474 - DNA, 20 bp, Artificial Sequence
  Description of Artificial Sequence: Synthetic oligonucleotide
aaaatctagtcagtgaatcc

SEQ ID NO: 25475 - DNA, 20 bp, Artificial Sequence
  Description of Artificial Sequence: Synthetic oligonucleotide
taaaatctagtcagtgaatc

SEQ ID NO: 25476 - DNA, 20 bp, Artificial Sequence
  Description of Artificial Sequence: Synthetic oligonucleotide
gtaaaatctagtcagtgaat

SEQ ID NO: 25477 - DNA, 20 bp, Artificial Sequence
  Description of Artificial Sequence: Synthetic oligonucleotide
agtaaaatctagtcagtgaa

SEQ ID NO: 25478 - DNA, 20 bp, Artificial Sequence
  Description of Artificial Sequence: Synthetic oligonucleotide
cagtaaaatctagtcagtga

SEQ ID NO: 25479 - DNA, 20 bp, Artificial Sequence
  Description of Artificial Sequence: Synthetic oligonucleotide
tcagtaaaatctagtcagtg

SEQ ID NO: 25480 - DNA, 20 bp, Artificial Sequence
  Description of Artificial Sequence: Synthetic oligonucleotide
ttcagtaaaatctagtcagt

SEQ ID NO: 25481 - DNA, 20 bp, Artificial Sequence
  Description of Artificial Sequence: Synthetic oligonucleotide
gttcagtaaaatctagtcag

SEQ ID NO: 25482 - DNA, 20 bp, Artificial Sequence
  Description of Artificial Sequence: Synthetic oligonucleotide
agttcagtaaaatctagtca

SEQ ID NO: 25483 - DNA, 20 bp, Artificial Sequence
  Description of Artificial Sequence: Synthetic oligonucleotide
tagttcagtaaaatctagtc

SEQ ID NO: 25484 - DNA, 20 bp, Artificial Sequence
  Description of Artificial Sequence: Synthetic oligonucleotide
atagttcagtaaaatctagt

SEQ ID NO: 25485 - DNA, 20 bp, Artificial Sequence
  Description of Artificial Sequence: Synthetic oligonucleotide
catagttcagtaaaatctag

SEQ ID NO: 25486 - DNA, 20 bp, Artificial Sequence
  Description of Artificial Sequence: Synthetic oligonucleotide
tcatagttcagtaaaatcta

SEQ ID NO: 25487 - DNA, 20 bp, Artificial Sequence
  Description of Artificial Sequence: Synthetic oligonucleotide
ttcatagttcagtaaaatct

SEQ ID NO: 25488 - DNA, 20 bp, Artificial Sequence
  Description of Artificial Sequence: Synthetic oligonucleotide
tttcatagttcagtaaaatc

SEQ ID NO: 25489 - DNA, 20 bp, Artificial Sequence
  Description of Artificial Sequence: Synthetic oligonucleotide
ttttcatagttcagtaaaat

SEQ ID NO: 25490 - DNA, 20 bp, Artificial Sequence
  Description of Artificial Sequence: Synthetic oligonucleotide
attttcatagttcagtaaaa

SEQ ID NO: 25491 - DNA, 20 bp, Artificial Sequence
  Description of Artificial Sequence: Synthetic oligonucleotide
tattttcatagttcagtaaa

SEQ ID NO: 25492 - DNA, 20 bp, Artificial Sequence
  Description of Artificial Sequence: Synthetic oligonucleotide
ttattttcatagttcagtaa

SEQ ID NO: 25493 - DNA, 20 bp, Artificial Sequence
  Description of Artificial Sequence: Synthetic oligonucleotide
tttattttcatagttcagta

SEQ ID NO: 25494 - DNA, 20 bp, Artificial Sequence
  Description of Artificial Sequence: Synthetic oligonucleotide
atttattttcatagttcagt

SEQ ID NO: 25495 - DNA, 20 bp, Artificial Sequence
  Description of Artificial Sequence: Synthetic oligonucleotide
tatttattttcatagttcag

SEQ ID NO: 25496 - DNA, 20 bp, Artificial Sequence
  Description of Artificial Sequence: Synthetic oligonucleotide
gtatttattttcatagttca

SEQ ID NO: 25497 - DNA, 20 bp, Artificial Sequence
  Description of Artificial Sequence: Synthetic oligonucleotide
tgtatttattttcatagttc

SEQ ID NO: 25498 - DNA, 20 bp, Artificial Sequence
  Description of Artificial Sequence: Synthetic oligonucleotide
gtgtatttattttcatagtt

SEQ ID NO: 25499 - DNA, 20 bp, Artificial Sequence
  Description of Artificial Sequence: Synthetic oligonucleotide
tgtgtatttattttcatagt

SEQ ID NO: 25500 - DNA, 20 bp, Artificial Sequence
  Description of Artificial Sequence: Synthetic oligonucleotide
atgtgtatttattttcatag

SEQ ID NO: 25501 - DNA, 20 bp, Artificial Sequence
  Description of Artificial Sequence: Synthetic oligonucleotide
tatgtgtatttattttcata

SEQ ID NO: 25502 - DNA, 20 bp, Artificial Sequence
  Description of Artificial Sequence: Synthetic oligonucleotide
ttatgtgtatttattttcat

SEQ ID NO: 25503 - DNA, 20 bp, Artificial Sequence
  Description of Artificial Sequence: Synthetic oligonucleotide
attatgtgtatttattttca

SEQ ID NO: 25504 - DNA, 20 bp, Artificial Sequence
  Description of Artificial Sequence: Synthetic oligonucleotide
aattatgtgtatttattttc

SEQ ID NO: 25505 - DNA, 20 bp, Artificial Sequence
  Description of Artificial Sequence: Synthetic oligonucleotide
aaattatgtgtatttatttt

SEQ ID NO: 25506 - DNA, 20 bp, Artificial Sequence
  Description of Artificial Sequence: Synthetic oligonucleotide
aaaattatgtgtatttattt

SEQ ID NO: 25507 - DNA, 20 bp, Artificial Sequence
  Description of Artificial Sequence: Synthetic oligonucleotide
aaaaattatgtgtatttatt

SEQ ID NO: 25508 - DNA, 20 bp, Artificial Sequence
  Description of Artificial Sequence: Synthetic oligonucleotide
gaaaaattatgtgtatttat

SEQ ID NO: 25509 - DNA, 20 bp, Artificial Sequence
  Description of Artificial Sequence: Synthetic oligonucleotide
tgaaaaattatgtgtattta

SEQ ID NO: 25510 - DNA, 20 bp, Artificial Sequence
  Description of Artificial Sequence: Synthetic oligonucleotide
gtgaaaaattatgtgtattt

SEQ ID NO: 25511 - DNA, 20 bp, Artificial Sequence
  Description of Artificial Sequence: Synthetic oligonucleotide
tgtgaaaaattatgtgtatt

SEQ ID NO: 25512 - DNA, 20 bp, Artificial Sequence
  Description of Artificial Sequence: Synthetic oligonucleotide
ttgtgaaaaattatgtgtat

SEQ ID NO: 25513 - DNA, 20 bp, Artificial Sequence
  Description of Artificial Sequence: Synthetic oligonucleotide
tttgtgaaaaattatgtgta

SEQ ID NO: 25514 - DNA, 20 bp, Artificial Sequence
  Description of Artificial Sequence: Synthetic oligonucleotide
ttttgtgaaaaattatgtgt

SEQ ID NO: 25515 - DNA, 20 bp, Artificial Sequence
  Description of Artificial Sequence: Synthetic oligonucleotide
attttgtgaaaaattatgtg

SEQ ID NO: 25516 - DNA, 20 bp, Artificial Sequence
  Description of Artificial Sequence: Synthetic oligonucleotide
aattttgtgaaaaattatgt

SEQ ID NO: 25517 - DNA, 20 bp, Artificial Sequence
  Description of Artificial Sequence: Synthetic oligonucleotide
aaattttgtgaaaaattatg

SEQ ID NO: 25518 - DNA, 20 bp, Artificial Sequence
  Description of Artificial Sequence: Synthetic oligonucleotide
aaaattttgtgaaaaattat

SEQ ID NO: 25519 - DNA, 20 bp, Artificial Sequence
  Description of Artificial Sequence: Synthetic oligonucleotide
caaaattttgtgaaaaatta

SEQ ID NO: 25520 - DNA, 20 bp, Artificial Sequence
  Description of Artificial Sequence: Synthetic oligonucleotide
ccaaaattttgtgaaaaatt

SEQ ID NO: 25521 - DNA, 20 bp, Artificial Sequence
  Description of Artificial Sequence: Synthetic oligonucleotide
cccaaaattttgtgaaaaat

SEQ ID NO: 25522 - DNA, 20 bp, Artificial Sequence
  Description of Artificial Sequence: Synthetic oligonucleotide
gcccaaaattttgtgaaaaa

SEQ ID NO: 25523 - DNA, 20 bp, Artificial Sequence
  Description of Artificial Sequence: Synthetic oligonucleotide
ggcccaaaattttgtgaaaa

SEQ ID NO: 25524 - DNA, 20 bp, Artificial Sequence
  Description of Artificial Sequence: Synthetic oligonucleotide
gggcccaaaattttgtgaaa

SEQ ID NO: 25525 - DNA, 20 bp, Artificial Sequence
  Description of Artificial Sequence: Synthetic oligonucleotide
tgggcccaaaattttgtgaa

SEQ ID NO: 25526 - DNA, 20 bp, Artificial Sequence
  Description of Artificial Sequence: Synthetic oligonucleotide
ttgggcccaaaattttgtga

SEQ ID NO: 25527 - DNA, 20 bp, Artificial Sequence
  Description of Artificial Sequence: Synthetic oligonucleotide
attgggcccaaaattttgtg

SEQ ID NO: 25528 - DNA, 20 bp, Artificial Sequence
  Description of Artificial Sequence: Synthetic oligonucleotide
aattgggcccaaaattttgt

SEQ ID NO: 25529 - DNA, 20 bp, Artificial Sequence
  Description of Artificial Sequence: Synthetic oligonucleotide
gaattgggcccaaaattttg

SEQ ID NO: 25530 - DNA, 20 bp, Artificial Sequence
  Description of Artificial Sequence: Synthetic oligonucleotide
ggaattgggcccaaaatttt

SEQ ID NO: 25531 - DNA, 20 bp, Artificial Sequence
  Description of Artificial Sequence: Synthetic oligonucleotide
gggaattgggcccaaaattt

SEQ ID NO: 25532 - DNA, 20 bp, Artificial Sequence
  Description of Artificial Sequence: Synthetic oligonucleotide
ggggaattgggcccaaaatt

SEQ ID NO: 25533 - DNA, 20 bp, Artificial Sequence
  Description of Artificial Sequence: Synthetic oligonucleotide
aggggaattgggcccaaaat

SEQ ID NO: 25534 - DNA, 20 bp, Artificial Sequence
  Description of Artificial Sequence: Synthetic oligonucleotide
taggggaattgggcccaaaa

SEQ ID NO: 25535 - DNA, 20 bp, Artificial Sequence
  Description of Artificial Sequence: Synthetic oligonucleotide
ttaggggaattgggcccaaa

SEQ ID NO: 25536 - DNA, 20 bp, Artificial Sequence
  Description of Artificial Sequence: Synthetic oligonucleotide
tttaggggaattgggcccaa

SEQ ID NO: 25537 - DNA, 20 bp, Artificial Sequence
  Description of Artificial Sequence: Synthetic oligonucleotide
ttttaggggaattgggccca

SEQ ID NO: 25538 - DNA, 20 bp, Artificial Sequence
  Description of Artificial Sequence: Synthetic oligonucleotide
cttttaggggaattgggccc

SEQ ID NO: 25539 - DNA, 20 bp, Artificial Sequence
  Description of Artificial Sequence: Synthetic oligonucleotide
tcttttaggggaattgggcc

SEQ ID NO: 25540 - DNA, 20 bp, Artificial Sequence
  Description of Artificial Sequence: Synthetic oligonucleotide
ttcttttaggggaattgggc

SEQ ID NO: 25541 - DNA, 20 bp, Artificial Sequence
  Description of Artificial Sequence: Synthetic oligonucleotide
attcttttaggggaattggg

SEQ ID NO: 25542 - DNA, 20 bp, Artificial Sequence
  Description of Artificial Sequence: Synthetic oligonucleotide
aattcttttaggggaattgg

SEQ ID NO: 25543 - DNA, 20 bp, Artificial Sequence
  Description of Artificial Sequence: Synthetic oligonucleotide
caattcttttaggggaattg

SEQ ID NO: 25544 - DNA, 20 bp, Artificial Sequence
  Description of Artificial Sequence: Synthetic oligonucleotide
tcaattcttttaggggaatt

SEQ ID NO: 25545 - DNA, 20 bp, Artificial Sequence
  Description of Artificial Sequence: Synthetic oligonucleotide
ctcaattcttttaggggaat

SEQ ID NO: 25546 - DNA, 20 bp, Artificial Sequence
  Description of Artificial Sequence: Synthetic oligonucleotide
cctcaattcttttaggggaa

SEQ ID NO: 25547 - DNA, 20 bp, Artificial Sequence
  Description of Artificial Sequence: Synthetic oligonucleotide
tcctcaattcttttagggga

SEQ ID NO: 25548 - DNA, 20 bp, Artificial Sequence
  Description of Artificial Sequence: Synthetic oligonucleotide
atcctcaattcttttagggg

SEQ ID NO: 25549 - DNA, 20 bp, Artificial Sequence
  Description of Artificial Sequence: Synthetic oligonucleotide
aatcctcaattcttttaggg

SEQ ID NO: 25550 - DNA, 20 bp, Artificial Sequence
  Description of Artificial Sequence: Synthetic oligonucleotide
taatcctcaattcttttagg

SEQ ID NO: 25551 - DNA, 20 bp, Artificial Sequence
  Description of Artificial Sequence: Synthetic oligonucleotide
ctaatcctcaattcttttag

SEQ ID NO: 25552 - DNA, 20 bp, Artificial Sequence
  Description of Artificial Sequence: Synthetic oligonucleotide
cctaatcctcaattctttta

SEQ ID NO: 25553 - DNA, 20 bp, Artificial Sequence
  Description of Artificial Sequence: Synthetic oligonucleotide
ccctaatcctcaattctttt

SEQ ID NO: 25554 - DNA, 20 bp, Artificial Sequence
  Description of Artificial Sequence: Synthetic oligonucleotide
tccctaatcctcaattcttt

SEQ ID NO: 25555 - DNA, 20 bp, Artificial Sequence
  Description of Artificial Sequence: Synthetic oligonucleotide
ctccctaatcctcaattctt

SEQ ID NO: 25556 - DNA, 20 bp, Artificial Sequence
  Description of Artificial Sequence: Synthetic oligonucleotide
tctccctaatcctcaattct

SEQ ID NO: 25557 - DNA, 20 bp, Artificial Sequence
  Description of Artificial Sequence: Synthetic oligonucleotide
ttctccctaatcctcaattc

SEQ ID NO: 25558 - DNA, 20 bp, Artificial Sequence
  Description of Artificial Sequence: Synthetic oligonucleotide
tttctccctaatcctcaatt

SEQ ID NO: 25559 - DNA, 20 bp, Artificial Sequence
  Description of Artificial Sequence: Synthetic oligonucleotide
ctttctccctaatcctcaat

SEQ ID NO: 25560 - DNA, 20 bp, Artificial Sequence
  Description of Artificial Sequence: Synthetic oligonucleotide
cctttctccctaatcctcaa

SEQ ID NO: 25561 - DNA, 20 bp, Artificial Sequence
  Description of Artificial Sequence: Synthetic oligonucleotide
tcctttctccctaatcctca

SEQ ID NO: 25562 - DNA, 20 bp, Artificial Sequence
  Description of Artificial Sequence: Synthetic oligonucleotide
ctcctttctccctaatcctc

SEQ ID NO: 25563 - DNA, 20 bp, Artificial Sequence
  Description of Artificial Sequence: Synthetic oligonucleotide
tctcctttctccctaatcct

SEQ ID NO: 25564 - DNA, 20 bp, Artificial Sequence
  Description of Artificial Sequence: Synthetic oligonucleotide
gtctcctttctccctaatcc

SEQ ID NO: 25565 - DNA, 20 bp, Artificial Sequence
  Description of Artificial Sequence: Synthetic oligonucleotide
tgtctcctttctccctaatc

SEQ ID NO: 25566 - DNA, 20 bp, Artificial Sequence
  Description of Artificial Sequence: Synthetic oligonucleotide
ttgtctcctttctccctaat

SEQ ID NO: 25567 - DNA, 20 bp, Artificial Sequence
  Description of Artificial Sequence: Synthetic oligonucleotide
gttgtctcctttctccctaa

SEQ ID NO: 25568 - DNA, 20 bp, Artificial Sequence
  Description of Artificial Sequence: Synthetic oligonucleotide
agttgtctcctttctcccta

SEQ ID NO: 25569 - DNA, 20 bp, Artificial Sequence
  Description of Artificial Sequence: Synthetic oligonucleotide
gagttgtctcctttctccct

SEQ ID NO: 25570 - DNA, 20 bp, Artificial Sequence
  Description of Artificial Sequence: Synthetic oligonucleotide
tgagttgtctcctttctccc

SEQ ID NO: 25571 - DNA, 20 bp, Artificial Sequence
  Description of Artificial Sequence: Synthetic oligonucleotide
ttgagttgtctcctttctcc

SEQ ID NO: 25572 - DNA, 20 bp, Artificial Sequence
  Description of Artificial Sequence: Synthetic oligonucleotide
tttgagttgtctcctttctc

SEQ ID NO: 25573 - DNA, 20 bp, Artificial Sequence
  Description of Artificial Sequence: Synthetic oligonucleotide
ctttgagttgtctcctttct

SEQ ID NO: 25574 - DNA, 20 bp, Artificial Sequence
  Description of Artificial Sequence: Synthetic oligonucleotide
actttgagttgtctcctttc

SEQ ID NO: 25575 - DNA, 20 bp, Artificial Sequence
  Description of Artificial Sequence: Synthetic oligonucleotide
gactttgagttgtctccttt

SEQ ID NO: 25576 - DNA, 20 bp, Artificial Sequence
  Description of Artificial Sequence: Synthetic oligonucleotide
tgactttgagttgtctcctt

SEQ ID NO: 25577 - DNA, 20 bp, Artificial Sequence
  Description of Artificial Sequence: Synthetic oligonucleotide
atgactttgagttgtctcct

SEQ ID NO: 25578 - DNA, 20 bp, Artificial Sequence
  Description of Artificial Sequence: Synthetic oligonucleotide
gatgactttgagttgtctcc

SEQ ID NO: 25579 - DNA, 20 bp, Artificial Sequence
  Description of Artificial Sequence: Synthetic oligonucleotide
ggatgactttgagttgtctc

SEQ ID NO: 25580 - DNA, 20 bp, Artificial Sequence
  Description of Artificial Sequence: Synthetic oligonucleotide
gggatgactttgagttgtct

SEQ ID NO: 25581 - DNA, 20 bp, Artificial Sequence
  Description of Artificial Sequence: Synthetic oligonucleotide
tgggatgactttgagttgtc

SEQ ID NO: 25582 - DNA, 20 bp, Artificial Sequence
  Description of Artificial Sequence: Synthetic oligonucleotide
atgggatgactttgagttgt

SEQ ID NO: 25583 - DNA, 20 bp, Artificial Sequence
  Description of Artificial Sequence: Synthetic oligonucleotide
aatgggatgactttgagttg

SEQ ID NO: 25584 - DNA, 20 bp, Artificial Sequence
  Description of Artificial Sequence: Synthetic oligonucleotide
taatgggatgactttgagtt

SEQ ID NO: 25585 - DNA, 20 bp, Artificial Sequence
  Description of Artificial Sequence: Synthetic oligonucleotide
ttaatgggatgactttgagt

SEQ ID NO: 25586 - DNA, 20 bp, Artificial Sequence
  Description of Artificial Sequence: Synthetic oligonucleotide
cttaatgggatgactttgag

SEQ ID NO: 25587 - DNA, 20 bp, Artificial Sequence
  Description of Artificial Sequence: Synthetic oligonucleotide
acttaatgggatgactttga

SEQ ID NO: 25588 - DNA, 20 bp, Artificial Sequence
  Description of Artificial Sequence: Synthetic oligonucleotide
cacttaatgggatgactttg

SEQ ID NO: 25589 - DNA, 20 bp, Artificial Sequence
  Description of Artificial Sequence: Synthetic oligonucleotide
gcacttaatgggatgacttt

SEQ ID NO: 25590 - DNA, 20 bp, Artificial Sequence
  Description of Artificial Sequence: Synthetic oligonucleotide
tgcacttaatgggatgactt

SEQ ID NO: 25591 - DNA, 20 bp, Artificial Sequence
  Description of Artificial Sequence: Synthetic oligonucleotide
ctgcacttaatgggatgact

SEQ ID NO: 25592 - DNA, 20 bp, Artificial Sequence
  Description of Artificial Sequence: Synthetic oligonucleotide
actgcacttaatgggatgac

SEQ ID NO: 25593 - DNA, 20 bp, Artificial Sequence
  Description of Artificial Sequence: Synthetic oligonucleotide
aactgcacttaatgggatga

SEQ ID NO: 25594 - DNA, 20 bp, Artificial Sequence
  Description of Artificial Sequence: Synthetic oligonucleotide
aaactgcacttaatgggatg

SEQ ID NO: 25595 - DNA, 20 bp, Artificial Sequence
  Description of Artificial Sequence: Synthetic oligonucleotide
gaaactgcacttaatgggat

SEQ ID NO: 25596 - DNA, 20 bp, Artificial Sequence
  Description of Artificial Sequence: Synthetic oligonucleotide
agaaactgcacttaatggga

SEQ ID NO: 25597 - DNA, 20 bp, Artificial Sequence
  Description of Artificial Sequence: Synthetic oligonucleotide
aagaaactgcacttaatggg

SEQ ID NO: 25598 - DNA, 20 bp, Artificial Sequence
  Description of Artificial Sequence: Synthetic oligonucleotide
aaagaaactgcacttaatgg

SEQ ID NO: 25599 - DNA, 20 bp, Artificial Sequence
  Description of Artificial Sequence: Synthetic oligonucleotide
caaagaaactgcacttaatg

SEQ ID NO: 25600 - DNA, 20 bp, Artificial Sequence
  Description of Artificial Sequence: Synthetic oligonucleotide
tcaaagaaactgcacttaat

SEQ ID NO: 25601 - DNA, 20 bp, Artificial Sequence
  Description of Artificial Sequence: Synthetic oligonucleotide
ttcaaagaaactgcacttaa

SEQ ID NO: 25602 - DNA, 20 bp, Artificial Sequence
  Description of Artificial Sequence: Synthetic oligonucleotide
attcaaagaaactgcactta

SEQ ID NO: 25603 - DNA, 20 bp, Artificial Sequence
  Description of Artificial Sequence: Synthetic oligonucleotide
gattcaaagaaactgcactt

SEQ ID NO: 25604 - DNA, 20 bp, Artificial Sequence
  Description of Artificial Sequence: Synthetic oligonucleotide
agattcaaagaaactgcact

SEQ ID NO: 25605 - DNA, 20 bp, Artificial Sequence
  Description of Artificial Sequence: Synthetic oligonucleotide
aagattcaaagaaactgcac

SEQ ID NO: 25606 - DNA, 20 bp, Artificial Sequence
  Description of Artificial Sequence: Synthetic oligonucleotide
gaagattcaaagaaactgca

SEQ ID NO: 25607 - DNA, 20 bp, Artificial Sequence
  Description of Artificial Sequence: Synthetic oligonucleotide
agaagattcaaagaaactgc

SEQ ID NO: 25608 - DNA, 20 bp, Artificial Sequence
  Description of Artificial Sequence: Synthetic oligonucleotide
cagaagattcaaagaaactg

SEQ ID NO: 25609 - DNA, 20 bp, Artificial Sequence
  Description of Artificial Sequence: Synthetic oligonucleotide
gcagaagattcaaagaaact

SEQ ID NO: 25610 - DNA, 20 bp, Artificial Sequence
  Description of Artificial Sequence: Synthetic oligonucleotide
agcagaagattcaaagaaac

SEQ ID NO: 25611 - DNA, 20 bp, Artificial Sequence
  Description of Artificial Sequence: Synthetic oligonucleotide
aagcagaagattcaaagaaa

SEQ ID NO: 25612 - DNA, 20 bp, Artificial Sequence
  Description of Artificial Sequence: Synthetic oligonucleotide
aaagcagaagattcaaagaa

SEQ ID NO: 25613 - DNA, 20 bp, Artificial Sequence
  Description of Artificial Sequence: Synthetic oligonucleotide
taaagcagaagattcaaaga

SEQ ID NO: 25614 - DNA, 20 bp, Artificial Sequence
  Description of Artificial Sequence: Synthetic oligonucleotide
ataaagcagaagattcaaag

SEQ ID NO: 25615 - DNA, 20 bp, Artificial Sequence
  Description of Artificial Sequence: Synthetic oligonucleotide
gataaagcagaagattcaaa

SEQ ID NO: 25616 - DNA, 20 bp, Artificial Sequence
  Description of Artificial Sequence: Synthetic oligonucleotide
agataaagcagaagattcaa

SEQ ID NO: 25617 - DNA, 20 bp, Artificial Sequence
  Description of Artificial Sequence: Synthetic oligonucleotide
aagataaagcagaagattca

SEQ ID NO: 25618 - DNA, 20 bp, Artificial Sequence
  Description of Artificial Sequence: Synthetic oligonucleotide
aaagataaagcagaagattc

SEQ ID NO: 25619 - DNA, 20 bp, Artificial Sequence
  Description of Artificial Sequence: Synthetic oligonucleotide
taaagataaagcagaagatt

SEQ ID NO: 25620 - DNA, 20 bp, Artificial Sequence
  Description of Artificial Sequence: Synthetic oligonucleotide
ttaaagataaagcagaagat

SEQ ID NO: 25621 - DNA, 20 bp, Artificial Sequence
  Description of Artificial Sequence: Synthetic oligonucleotide
tttaaagataaagcagaaga

SEQ ID NO: 25622 - DNA, 20 bp, Artificial Sequence
  Description of Artificial Sequence: Synthetic oligonucleotide
ttttaaagataaagcagaag

SEQ ID NO: 25623 - DNA, 20 bp, Artificial Sequence
  Description of Artificial Sequence: Synthetic oligonucleotide
tttttaaagataaagcagaa

SEQ ID NO: 25624 - DNA, 20 bp, Artificial Sequence
  Description of Artificial Sequence: Synthetic oligonucleotide
atttttaaagataaagcaga

SEQ ID NO: 25625 - DNA, 20 bp, Artificial Sequence
  Description of Artificial Sequence: Synthetic oligonucleotide
aatttttaaagataaagcag

SEQ ID NO: 25626 - DNA, 20 bp, Artificial Sequence
  Description of Artificial Sequence: Synthetic oligonucleotide
aaatttttaaagataaagca

SEQ ID NO: 25627 - DNA, 20 bp, Artificial Sequence
  Description of Artificial Sequence: Synthetic oligonucleotide
caaatttttaaagataaagc

SEQ ID NO: 25628 - DNA, 20 bp, Artificial Sequence
  Description of Artificial Sequence: Synthetic oligonucleotide
acaaatttttaaagataaag

SEQ ID NO: 25629 - DNA, 20 bp, Artificial Sequence
  Description of Artificial Sequence: Synthetic oligonucleotide
tacaaatttttaaagataaa

SEQ ID NO: 25630 - DNA, 20 bp, Artificial Sequence
  Description of Artificial Sequence: Synthetic oligonucleotide
atacaaatttttaaagataa

SEQ ID NO: 25631 - DNA, 20 bp, Artificial Sequence
  Description of Artificial Sequence: Synthetic oligonucleotide
tatacaaatttttaaagata

SEQ ID NO: 25632 - DNA, 20 bp, Artificial Sequence
  Description of Artificial Sequence: Synthetic oligonucleotide
ttatacaaatttttaaagat

SEQ ID NO: 25633 - DNA, 20 bp, Artificial Sequence
  Description of Artificial Sequence: Synthetic oligonucleotide
attatacaaatttttaaaga

SEQ ID NO: 25634 - DNA, 20 bp, Artificial Sequence
  Description of Artificial Sequence: Synthetic oligonucleotide
aattatacaaatttttaaag

SEQ ID NO: 25635 - DNA, 20 bp, Artificial Sequence
  Description of Artificial Sequence: Synthetic oligonucleotide
aaattatacaaatttttaaa

SEQ ID NO: 25636 - DNA, 20 bp, Artificial Sequence
  Description of Artificial Sequence: Synthetic oligonucleotide
taaattatacaaatttttaa

SEQ ID NO: 25637 - DNA, 20 bp, Artificial Sequence
  Description of Artificial Sequence: Synthetic oligonucleotide
ataaattatacaaattttta

SEQ ID NO: 25638 - DNA, 20 bp, Artificial Sequence
  Description of Artificial Sequence: Synthetic oligonucleotide
tataaattatacaaattttt

SEQ ID NO: 25639 - DNA, 20 bp, Artificial Sequence
  Description of Artificial Sequence: Synthetic oligonucleotide
atataaattatacaaatttt

SEQ ID NO: 25640 - DNA, 20 bp, Artificial Sequence
  Description of Artificial Sequence: Synthetic oligonucleotide
tatataaattatacaaattt

SEQ ID NO: 25641 - DNA, 20 bp, Artificial Sequence
  Description of Artificial Sequence: Synthetic oligonucleotide
atatataaattatacaaatt

SEQ ID NO: 25642 - DNA, 20 bp, Artificial Sequence
  Description of Artificial Sequence: Synthetic oligonucleotide
aatatataaattatacaaat

SEQ ID NO: 25643 - DNA, 20 bp, Artificial Sequence
  Description of Artificial Sequence: Synthetic oligonucleotide
aaatatataaattatacaaa

SEQ ID NO: 25644 - DNA, 20 bp, Artificial Sequence
  Description of Artificial Sequence: Synthetic oligonucleotide
aaaatatataaattatacaa

SEQ ID NO: 25645 - DNA, 20 bp, Artificial Sequence
  Description of Artificial Sequence: Synthetic oligonucleotide
taaaatatataaattataca

SEQ ID NO: 25646 - DNA, 20 bp, Artificial Sequence
  Description of Artificial Sequence: Synthetic oligonucleotide
ataaaatatataaattatac

SEQ ID NO: 25647 - DNA, 20 bp, Artificial Sequence
  Description of Artificial Sequence: Synthetic oligonucleotide
aataaaatatataaattata

SEQ ID NO: 25648 - DNA, 20 bp, Artificial Sequence
  Description of Artificial Sequence: Synthetic oligonucleotide
gaataaaatatataaattat

SEQ ID NO: 25649 - DNA, 20 bp, Artificial Sequence
  Description of Artificial Sequence: Synthetic oligonucleotide
agaataaaatatataaatta

SEQ ID NO: 25650 - DNA, 20 bp, Artificial Sequence
  Description of Artificial Sequence: Synthetic oligonucleotide
tagaataaaatatataaatt

SEQ ID NO: 25651 - DNA, 20 bp, Artificial Sequence
  Description of Artificial Sequence: Synthetic oligonucleotide
atagaataaaatatataaat

SEQ ID NO: 25652 - DNA, 20 bp, Artificial Sequence
  Description of Artificial Sequence: Synthetic oligonucleotide
catagaataaaatatataaa

SEQ ID NO: 25653 - DNA, 20 bp, Artificial Sequence
  Description of Artificial Sequence: Synthetic oligonucleotide
acatagaataaaatatataa

SEQ ID NO: 25654 - DNA, 20 bp, Artificial Sequence
  Description of Artificial Sequence: Synthetic oligonucleotide
cacatagaataaaatatata

SEQ ID NO: 25655 - DNA, 20 bp, Artificial Sequence
  Description of Artificial Sequence: Synthetic oligonucleotide
acacatagaataaaatatat

SEQ ID NO: 25656 - DNA, 20 bp, Artificial Sequence
  Description of Artificial Sequence: Synthetic oligonucleotide
aacacatagaataaaatata

SEQ ID NO: 25657 - DNA, 20 bp, Artificial Sequence
  Description of Artificial Sequence: Synthetic oligonucleotide
gaacacatagaataaaatat

SEQ ID NO: 25658 - DNA, 20 bp, Artificial Sequence
  Description of Artificial Sequence: Synthetic oligonucleotide
ggaacacatagaataaaata

SEQ ID NO: 25659 - DNA, 20 bp, Artificial Sequence
  Description of Artificial Sequence: Synthetic oligonucleotide
tggaacacatagaataaaat

SEQ ID NO: 25660 - DNA, 20 bp, Artificial Sequence
  Description of Artificial Sequence: Synthetic oligonucleotide
atggaacacatagaataaaa

SEQ ID NO: 25661 - DNA, 20 bp, Artificial Sequence
  Description of Artificial Sequence: Synthetic oligonucleotide
tatggaacacatagaataaa

SEQ ID NO: 25662 - DNA, 20 bp, Artificial Sequence
  Description of Artificial Sequence: Synthetic oligonucleotide
ctatggaacacatagaataa

SEQ ID NO: 25663 - DNA, 20 bp, Artificial Sequence
  Description of Artificial Sequence: Synthetic oligonucleotide
tctatggaacacatagaata

SEQ ID NO: 25664 - DNA, 20 bp, Artificial Sequence
  Description of Artificial Sequence: Synthetic oligonucleotide
atctatggaacacatagaat

SEQ ID NO: 25665 - DNA, 20 bp, Artificial Sequence
  Description of Artificial Sequence: Synthetic oligonucleotide
tatctatggaacacatagaa

SEQ ID NO: 25666 - DNA, 20 bp, Artificial Sequence
  Description of Artificial Sequence: Synthetic oligonucleotide
atatctatggaacacataga

SEQ ID NO: 25667 - DNA, 20 bp, Artificial Sequence
  Description of Artificial Sequence: Synthetic oligonucleotide
gatatctatggaacacatag

SEQ ID NO: 25668 - DNA, 20 bp, Artificial Sequence
  Description of Artificial Sequence: Synthetic oligonucleotide
agatatctatggaacacata

SEQ ID NO: 25669 - DNA, 20 bp, Artificial Sequence
  Description of Artificial Sequence: Synthetic oligonucleotide
aagatatctatggaacacat

SEQ ID NO: 25670 - DNA, 20 bp, Artificial Sequence
  Description of Artificial Sequence: Synthetic oligonucleotide
taagatatctatggaacaca

SEQ ID NO: 25671 - DNA, 20 bp, Artificial Sequence
  Description of Artificial Sequence: Synthetic oligonucleotide
ttaagatatctatggaacac

SEQ ID NO: 25672 - DNA, 20 bp, Artificial Sequence
  Description of Artificial Sequence: Synthetic oligonucleotide
attaagatatctatggaaca

SEQ ID NO: 25673 - DNA, 20 bp, Artificial Sequence
  Description of Artificial Sequence: Synthetic oligonucleotide
cattaagatatctatggaac

SEQ ID NO: 25674 - DNA, 20 bp, Artificial Sequence
  Description of Artificial Sequence: Synthetic oligonucleotide
acattaagatatctatggaa

SEQ ID NO: 25675 - DNA, 20 bp, Artificial Sequence
  Description of Artificial Sequence: Synthetic oligonucleotide
tacattaagatatctatgga

SEQ ID NO: 25676 - DNA, 20 bp, Artificial Sequence
  Description of Artificial Sequence: Synthetic oligonucleotide
ttacattaagatatctatgg

SEQ ID NO: 25677 - DNA, 20 bp, Artificial Sequence
  Description of Artificial Sequence: Synthetic oligonucleotide
tttacattaagatatctatg

SEQ ID NO: 25678 - DNA, 20 bp, Artificial Sequence
  Description of Artificial Sequence: Synthetic oligonucleotide
ttttacattaagatatctat

SEQ ID NO: 25679 - DNA, 20 bp, Artificial Sequence
  Description of Artificial Sequence: Synthetic oligonucleotide
attttacattaagatatcta

SEQ ID NO: 25680 - DNA, 20 bp, Artificial Sequence
  Description of Artificial Sequence: Synthetic oligonucleotide
aattttacattaagatatct

SEQ ID NO: 25681 - DNA, 20 bp, Artificial Sequence
  Description of Artificial Sequence: Synthetic oligonucleotide
taattttacattaagatatc

SEQ ID NO: 25682 - DNA, 20 bp, Artificial Sequence
  Description of Artificial Sequence: Synthetic oligonucleotide
ctaattttacattaagatat

SEQ ID NO: 25683 - DNA, 20 bp, Artificial Sequence
  Description of Artificial Sequence: Synthetic oligonucleotide
actaattttacattaagata

SEQ ID NO: 25684 - DNA, 20 bp, Artificial Sequence
  Description of Artificial Sequence: Synthetic oligonucleotide
gactaattttacattaagat

SEQ ID NO: 25685 - DNA, 20 bp, Artificial Sequence
  Description of Artificial Sequence: Synthetic oligonucleotide
tgactaattttacattaaga

SEQ ID NO: 25686 - DNA, 20 bp, Artificial Sequence
  Description of Artificial Sequence: Synthetic oligonucleotide
atgactaattttacattaag

SEQ ID NO: 25687 - DNA, 20 bp, Artificial Sequence
  Description of Artificial Sequence: Synthetic oligonucleotide
aatgactaattttacattaa

SEQ ID NO: 25688 - DNA, 20 bp, Artificial Sequence
  Description of Artificial Sequence: Synthetic oligonucleotide
aaatgactaattttacatta

SEQ ID NO: 25689 - DNA, 20 bp, Artificial Sequence
  Description of Artificial Sequence: Synthetic oligonucleotide
taaatgactaattttacatt

SEQ ID NO: 25690 - DNA, 20 bp, Artificial Sequence
  Description of Artificial Sequence: Synthetic oligonucleotide
ttaaatgactaattttacat

SEQ ID NO: 25691 - DNA, 20 bp, Artificial Sequence
  Description of Artificial Sequence: Synthetic oligonucleotide
tttaaatgactaattttaca

SEQ ID NO: 25692 - DNA, 20 bp, Artificial Sequence
  Description of Artificial Sequence: Synthetic oligonucleotide
atttaaatgactaattttac

SEQ ID NO: 25693 - DNA, 20 bp, Artificial Sequence
  Description of Artificial Sequence: Synthetic oligonucleotide
aatttaaatgactaatttta

SEQ ID NO: 25694 - DNA, 20 bp, Artificial Sequence
  Description of Artificial Sequence: Synthetic oligonucleotide
taatttaaatgactaatttt

SEQ ID NO: 25695 - DNA, 20 bp, Artificial Sequence
  Description of Artificial Sequence: Synthetic oligonucleotide
gtaatttaaatgactaattt

SEQ ID NO: 25696 - DNA, 20 bp, Artificial Sequence
  Description of Artificial Sequence: Synthetic oligonucleotide
tgtaatttaaatgactaatt

SEQ ID NO: 25697 - DNA, 20 bp, Artificial Sequence
  Description of Artificial Sequence: Synthetic oligonucleotide
gtgtaatttaaatgactaat

SEQ ID NO: 25698 - DNA, 20 bp, Artificial Sequence
  Description of Artificial Sequence: Synthetic oligonucleotide
agtgtaatttaaatgactaa

SEQ ID NO: 25699 - DNA, 20 bp, Artificial Sequence
  Description of Artificial Sequence: Synthetic oligonucleotide
cagtgtaatttaaatgacta

SEQ ID NO: 25700 - DNA, 20 bp, Artificial Sequence
  Description of Artificial Sequence: Synthetic oligonucleotide
acagtgtaatttaaatgact

SEQ ID NO: 25701 - DNA, 20 bp, Artificial Sequence
  Description of Artificial Sequence: Synthetic oligonucleotide
gacagtgtaatttaaatgac

SEQ ID NO: 25702 - DNA, 20 bp, Artificial Sequence
  Description of Artificial Sequence: Synthetic oligonucleotide
tgacagtgtaatttaaatga

SEQ ID NO: 25703 - DNA, 20 bp, Artificial Sequence
  Description of Artificial Sequence: Synthetic oligonucleotide
ttgacagtgtaatttaaatg

SEQ ID NO: 25704 - DNA, 20 bp, Artificial Sequence
  Description of Artificial Sequence: Synthetic oligonucleotide
attgacagtgtaatttaaat

SEQ ID NO: 25705 - DNA, 20 bp, Artificial Sequence
  Description of Artificial Sequence: Synthetic oligonucleotide
aattgacagtgtaatttaaa

SEQ ID NO: 25706 - DNA, 20 bp, Artificial Sequence
  Description of Artificial Sequence: Synthetic oligonucleotide
taattgacagtgtaatttaa

SEQ ID NO: 25707 - DNA, 20 bp, Artificial Sequence
  Description of Artificial Sequence: Synthetic oligonucleotide
ttaattgacagtgtaattta

SEQ ID NO: 25708 - DNA, 20 bp, Artificial Sequence
  Description of Artificial Sequence: Synthetic oligonucleotide
tttaattgacagtgtaattt

SEQ ID NO: 25709 - DNA, 20 bp, Artificial Sequence
  Description of Artificial Sequence: Synthetic oligonucleotide
ttttaattgacagtgtaatt

SEQ ID NO: 25710 - DNA, 20 bp, Artificial Sequence
  Description of Artificial Sequence: Synthetic oligonucleotide
cttttaattgacagtgtaat

SEQ ID NO: 25711 - DNA, 20 bp, Artificial Sequence
  Description of Artificial Sequence: Synthetic oligonucleotide
acttttaattgacagtgtaa

SEQ ID NO: 25712 - DNA, 20 bp, Artificial Sequence
  Description of Artificial Sequence: Synthetic oligonucleotide
tacttttaattgacagtgta

SEQ ID NO: 25713 - DNA, 20 bp, Artificial Sequence
  Description of Artificial Sequence: Synthetic oligonucleotide
ttacttttaattgacagtgt

SEQ ID NO: 25714 - DNA, 20 bp, Artificial Sequence
  Description of Artificial Sequence: Synthetic oligonucleotide
attacttttaattgacagtg

SEQ ID NO: 25715 - DNA, 20 bp, Artificial Sequence
  Description of Artificial Sequence: Synthetic oligonucleotide
cattacttttaattgacagt

SEQ ID NO: 25716 - DNA, 20 bp, Artificial Sequence
  Description of Artificial Sequence: Synthetic oligonucleotide
ccattacttttaattgacag

SEQ ID NO: 25717 - DNA, 20 bp, Artificial Sequence
  Description of Artificial Sequence: Synthetic oligonucleotide
cccattacttttaattgaca

SEQ ID NO: 25718 - DNA, 20 bp, Artificial Sequence
  Description of Artificial Sequence: Synthetic oligonucleotide
gcccattacttttaattgac

SEQ ID NO: 25719 - DNA, 20 bp, Artificial Sequence
  Description of Artificial Sequence: Synthetic oligonucleotide
tgcccattacttttaattga

SEQ ID NO: 25720 - DNA, 20 bp, Artificial Sequence
  Description of Artificial Sequence: Synthetic oligonucleotide
ttgcccattacttttaattg

SEQ ID NO: 25721 - DNA, 20 bp, Artificial Sequence
  Description of Artificial Sequence: Synthetic oligonucleotide
cttgcccattacttttaatt

SEQ ID NO: 25722 - DNA, 20 bp, Artificial Sequence
  Description of Artificial Sequence: Synthetic oligonucleotide
tcttgcccattacttttaat

SEQ ID NO: 25723 - DNA, 20 bp, Artificial Sequence
  Description of Artificial Sequence: Synthetic oligonucleotide
ctcttgcccattacttttaa

SEQ ID NO: 25724 - DNA, 20 bp, Artificial Sequence
  Description of Artificial Sequence: Synthetic oligonucleotide
tctcttgcccattactttta

SEQ ID NO: 25725 - DNA, 20 bp, Artificial Sequence
  Description of Artificial Sequence: Synthetic oligonucleotide
atctcttgcccattactttt

SEQ ID NO: 25726 - DNA, 20 bp, Artificial Sequence
  Description of Artificial Sequence: Synthetic oligonucleotide
aatctcttgcccattacttt

SEQ ID NO: 25727 - DNA, 20 bp, Artificial Sequence
  Description of Artificial Sequence: Synthetic oligonucleotide
caatctcttgcccattactt

SEQ ID NO: 25728 - DNA, 20 bp, Artificial Sequence
  Description of Artificial Sequence: Synthetic oligonucleotide
gcaatctcttgcccattact

SEQ ID NO: 25729 - DNA, 20 bp, Artificial Sequence
  Description of Artificial Sequence: Synthetic oligonucleotide
tgcaatctcttgcccattac

SEQ ID NO: 25730 - DNA, 20 bp, Artificial Sequence
  Description of Artificial Sequence: Synthetic oligonucleotide
atgcaatctcttgcccatta

SEQ ID NO: 25731 - DNA, 20 bp, Artificial Sequence
  Description of Artificial Sequence: Synthetic oligonucleotide
gatgcaatctcttgcccatt

SEQ ID NO: 25732 - DNA, 20 bp, Artificial Sequence
  Description of Artificial Sequence: Synthetic oligonucleotide
tgatgcaatctcttgcccat

SEQ ID NO: 25733 - DNA, 20 bp, Artificial Sequence
  Description of Artificial Sequence: Synthetic oligonucleotide
atgatgcaatctcttgccca

SEQ ID NO: 25734 - DNA, 20 bp, Artificial Sequence
  Description of Artificial Sequence: Synthetic oligonucleotide
tatgatgcaatctcttgccc

SEQ ID NO: 25735 - DNA, 20 bp, Artificial Sequence
  Description of Artificial Sequence: Synthetic oligonucleotide
gtatgatgcaatctcttgcc

SEQ ID NO: 25736 - DNA, 20 bp, Artificial Sequence
  Description of Artificial Sequence: Synthetic oligonucleotide
agtatgatgcaatctcttgc

SEQ ID NO: 25737 - DNA, 20 bp, Artificial Sequence
  Description of Artificial Sequence: Synthetic oligonucleotide
tagtatgatgcaatctcttg

SEQ ID NO: 25738 - DNA, 20 bp, Artificial Sequence
  Description of Artificial Sequence: Synthetic oligonucleotide
ttagtatgatgcaatctctt

SEQ ID NO: 25739 - DNA, 20 bp, Artificial Sequence
  Description of Artificial Sequence: Synthetic oligonucleotide
attagtatgatgcaatctct

SEQ ID NO: 25740 - DNA, 20 bp, Artificial Sequence
  Description of Artificial Sequence: Synthetic oligonucleotide
aattagtatgatgcaatctc

SEQ ID NO: 25741 - DNA, 20 bp, Artificial Sequence
  Description of Artificial Sequence: Synthetic oligonucleotide
aaattagtatgatgcaatct

SEQ ID NO: 25742 - DNA, 20 bp, Artificial Sequence
  Description of Artificial Sequence: Synthetic oligonucleotide
taaattagtatgatgcaatc

SEQ ID NO: 25743 - DNA, 20 bp, Artificial Sequence
  Description of Artificial Sequence: Synthetic oligonucleotide
ctaaattagtatgatgcaat

SEQ ID NO: 25744 - DNA, 20 bp, Artificial Sequence
  Description of Artificial Sequence: Synthetic oligonucleotide
actaaattagtatgatgcaa

SEQ ID NO: 25745 - DNA, 20 bp, Artificial Sequence
  Description of Artificial Sequence: Synthetic oligonucleotide
tactaaattagtatgatgca

SEQ ID NO: 25746 - DNA, 20 bp, Artificial Sequence
  Description of Artificial Sequence: Synthetic oligonucleotide
ttactaaattagtatgatgc

SEQ ID NO: 25747 - DNA, 20 bp, Artificial Sequence
  Description of Artificial Sequence: Synthetic oligonucleotide
cttactaaattagtatgatg

SEQ ID NO: 25748 - DNA, 20 bp, Artificial Sequence
  Description of Artificial Sequence: Synthetic oligonucleotide
tcttactaaattagtatgat

SEQ ID NO: 25749 - DNA, 20 bp, Artificial Sequence
  Description of Artificial Sequence: Synthetic oligonucleotide
ttcttactaaattagtatga

SEQ ID NO: 25750 - DNA, 20 bp, Artificial Sequence
  Description of Artificial Sequence: Synthetic oligonucleotide
gttcttactaaattagtatg

SEQ ID NO: 25751 - DNA, 20 bp, Artificial Sequence
  Description of Artificial Sequence: Synthetic oligonucleotide
cgttcttactaaattagtat

SEQ ID NO: 25752 - DNA, 20 bp, Artificial Sequence
  Description of Artificial Sequence: Synthetic oligonucleotide
acgttcttactaaattagta

SEQ ID NO: 25753 - DNA, 20 bp, Artificial Sequence
  Description of Artificial Sequence: Synthetic oligonucleotide
aacgttcttactaaattagt

SEQ ID NO: 25754 - DNA, 20 bp, Artificial Sequence
  Description of Artificial Sequence: Synthetic oligonucleotide
gaacgttcttactaaattag

SEQ ID NO: 25755 - DNA, 20 bp, Artificial Sequence
  Description of Artificial Sequence: Synthetic oligonucleotide
ggaacgttcttactaaatta

SEQ ID NO: 25756 - DNA, 20 bp, Artificial Sequence
  Description of Artificial Sequence: Synthetic oligonucleotide
gggaacgttcttactaaatt

SEQ ID NO: 25757 - DNA, 20 bp, Artificial Sequence
  Description of Artificial Sequence: Synthetic oligonucleotide
tgggaacgttcttactaaat

SEQ ID NO: 25758 - DNA, 20 bp, Artificial Sequence
  Description of Artificial Sequence: Synthetic oligonucleotide
ttgggaacgttcttactaaa

SEQ ID NO: 25759 - DNA, 20 bp, Artificial Sequence
  Description of Artificial Sequence: Synthetic oligonucleotide
tttgggaacgttcttactaa

SEQ ID NO: 25760 - DNA, 20 bp, Artificial Sequence
  Description of Artificial Sequence: Synthetic oligonucleotide
atttgggaacgttcttacta

SEQ ID NO: 25761 - DNA, 20 bp, Artificial Sequence
  Description of Artificial Sequence: Synthetic oligonucleotide
catttgggaacgttcttact

SEQ ID NO: 25762 - DNA, 20 bp, Artificial Sequence
  Description of Artificial Sequence: Synthetic oligonucleotide
acatttgggaacgttcttac

SEQ ID NO: 25763 - DNA, 20 bp, Artificial Sequence
  Description of Artificial Sequence: Synthetic oligonucleotide
aacatttgggaacgttctta

SEQ ID NO: 25764 - DNA, 20 bp, Artificial Sequence
  Description of Artificial Sequence: Synthetic oligonucleotide
caacatttgggaacgttctt

SEQ ID NO: 25765 - DNA, 20 bp, Artificial Sequence
  Description of Artificial Sequence: Synthetic oligonucleotide
acaacatttgggaacgttct

SEQ ID NO: 25766 - DNA, 20 bp, Artificial Sequence
  Description of Artificial Sequence: Synthetic oligonucleotide
tacaacatttgggaacgttc

SEQ ID NO: 25767 - DNA, 20 bp, Artificial Sequence
  Description of Artificial Sequence: Synthetic oligonucleotide
ttacaacatttgggaacgtt

SEQ ID NO: 25768 - DNA, 20 bp, Artificial Sequence
  Description of Artificial Sequence: Synthetic oligonucleotide
gttacaacatttgggaacgt

SEQ ID NO: 25769 - DNA, 20 bp, Artificial Sequence
  Description of Artificial Sequence: Synthetic oligonucleotide
tgttacaacatttgggaacg

SEQ ID NO: 25770 - DNA, 20 bp, Artificial Sequence
  Description of Artificial Sequence: Synthetic oligonucleotide
ttgttacaacatttgggaac

SEQ ID NO: 25771 - DNA, 20 bp, Artificial Sequence
  Description of Artificial Sequence: Synthetic oligonucleotide
attgttacaacatttgggaa

SEQ ID NO: 25772 - DNA, 20 bp, Artificial Sequence
  Description of Artificial Sequence: Synthetic oligonucleotide
cattgttacaacatttggga

SEQ ID NO: 25773 - DNA, 20 bp, Artificial Sequence
  Description of Artificial Sequence: Synthetic oligonucleotide
acattgttacaacatttggg

SEQ ID NO: 25774 - DNA, 20 bp, Artificial Sequence
  Description of Artificial Sequence: Synthetic oligonucleotide
cacattgttacaacatttgg

SEQ ID NO: 25775 - DNA, 20 bp, Artificial Sequence
  Description of Artificial Sequence: Synthetic oligonucleotide
ccacattgttacaacatttg

SEQ ID NO: 25776 - DNA, 20 bp, Artificial Sequence
  Description of Artificial Sequence: Synthetic oligonucleotide
tccacattgttacaacattt

SEQ ID NO: 25777 - DNA, 20 bp, Artificial Sequence
  Description of Artificial Sequence: Synthetic oligonucleotide
atccacattgttacaacatt

SEQ ID NO: 25778 - DNA, 20 bp, Artificial Sequence
  Description of Artificial Sequence: Synthetic oligonucleotide
gatccacattgttacaacat

SEQ ID NO: 25779 - DNA, 20 bp, Artificial Sequence
  Description of Artificial Sequence: Synthetic oligonucleotide
tgatccacattgttacaaca

SEQ ID NO: 25780 - DNA, 20 bp, Artificial Sequence
  Description of Artificial Sequence: Synthetic oligonucleotide
atgatccacattgttacaac

SEQ ID NO: 25781 - DNA, 20 bp, Artificial Sequence
  Description of Artificial Sequence: Synthetic oligonucleotide
tatgatccacattgttacaa

SEQ ID NO: 25782 - DNA, 20 bp, Artificial Sequence
  Description of Artificial Sequence: Synthetic oligonucleotide
gtatgatccacattgttaca

SEQ ID NO: 25783 - DNA, 20 bp, Artificial Sequence
  Description of Artificial Sequence: Synthetic oligonucleotide
tgtatgatccacattgttac

SEQ ID NO: 25784 - DNA, 20 bp, Artificial Sequence
  Description of Artificial Sequence: Synthetic oligonucleotide
atgtatgatccacattgtta

SEQ ID NO: 25785 - DNA, 20 bp, Artificial Sequence
  Description of Artificial Sequence: Synthetic oligonucleotide
gatgtatgatccacattgtt

SEQ ID NO: 25786 - DNA, 20 bp, Artificial Sequence
  Description of Artificial Sequence: Synthetic oligonucleotide
agatgtatgatccacattgt

SEQ ID NO: 25787 - DNA, 20 bp, Artificial Sequence
  Description of Artificial Sequence: Synthetic oligonucleotide
gagatgtatgatccacattg

SEQ ID NO: 25788 - DNA, 20 bp, Artificial Sequence
  Description of Artificial Sequence: Synthetic oligonucleotide
agagatgtatgatccacatt

SEQ ID NO: 25789 - DNA, 20 bp, Artificial Sequence
  Description of Artificial Sequence: Synthetic oligonucleotide
cagagatgtatgatccacat

SEQ ID NO: 25790 - DNA, 20 bp, Artificial Sequence
  Description of Artificial Sequence: Synthetic oligonucleotide
ccagagatgtatgatccaca

SEQ ID NO: 25791 - DNA, 20 bp, Artificial Sequence
  Description of Artificial Sequence: Synthetic oligonucleotide
accagagatgtatgatccac

SEQ ID NO: 25792 - DNA, 20 bp, Artificial Sequence
  Description of Artificial Sequence: Synthetic oligonucleotide
aaccagagatgtatgatcca

SEQ ID NO: 25793 - DNA, 20 bp, Artificial Sequence
  Description of Artificial Sequence: Synthetic oligonucleotide
aaaccagagatgtatgatcc

SEQ ID NO: 25794 - DNA, 20 bp, Artificial Sequence
  Description of Artificial Sequence: Synthetic oligonucleotide
aaaaccagagatgtatgatc

SEQ ID NO: 25795 - DNA, 20 bp, Artificial Sequence
  Description of Artificial Sequence: Synthetic oligonucleotide
aaaaaccagagatgtatgat

SEQ ID NO: 25796 - DNA, 20 bp, Artificial Sequence
  Description of Artificial Sequence: Synthetic oligonucleotide
aaaaaaccagagatgtatga

SEQ ID NO: 25797 - DNA, 20 bp, Artificial Sequence
  Description of Artificial Sequence: Synthetic oligonucleotide
taaaaaaccagagatgtatg

SEQ ID NO: 25798 - DNA, 20 bp, Artificial Sequence
  Description of Artificial Sequence: Synthetic oligonucleotide
ttaaaaaaccagagatgtat

SEQ ID NO: 25799 - DNA, 20 bp, Artificial Sequence
  Description of Artificial Sequence: Synthetic oligonucleotide
tttaaaaaaccagagatgta

SEQ ID NO: 25800 - DNA, 20 bp, Artificial Sequence
  Description of Artificial Sequence: Synthetic oligonucleotide
atttaaaaaaccagagatgt

SEQ ID NO: 25801 - DNA, 20 bp, Artificial Sequence
  Description of Artificial Sequence: Synthetic oligonucleotide
catttaaaaaaccagagatg

SEQ ID NO: 25802 - DNA, 20 bp, Artificial Sequence
  Description of Artificial Sequence: Synthetic oligonucleotide
acatttaaaaaaccagagat

SEQ ID NO: 25803 - DNA, 20 bp, Artificial Sequence
  Description of Artificial Sequence: Synthetic oligonucleotide
tacatttaaaaaaccagaga

SEQ ID NO: 25804 - DNA, 20 bp, Artificial Sequence
  Description of Artificial Sequence: Synthetic oligonucleotide
atacatttaaaaaaccagag

SEQ ID NO: 25805 - DNA, 20 bp, Artificial Sequence
  Description of Artificial Sequence: Synthetic oligonucleotide
aatacatttaaaaaaccaga

SEQ ID NO: 25806 - DNA, 20 bp, Artificial Sequence
  Description of Artificial Sequence: Synthetic oligonucleotide
caatacatttaaaaaaccag

SEQ ID NO: 25807 - DNA, 20 bp, Artificial Sequence
  Description of Artificial Sequence: Synthetic oligonucleotide
tcaatacatttaaaaaacca

SEQ ID NO: 25808 - DNA, 20 bp, Artificial Sequence
  Description of Artificial Sequence: Synthetic oligonucleotide
ctcaatacatttaaaaaacc

SEQ ID NO: 25809 - DNA, 20 bp, Artificial Sequence
  Description of Artificial Sequence: Synthetic oligonucleotide
cctcaatacatttaaaaaac

SEQ ID NO: 25810 - DNA, 20 bp, Artificial Sequence
  Description of Artificial Sequence: Synthetic oligonucleotide
gcctcaatacatttaaaaaa

SEQ ID NO: 25811 - DNA, 20 bp, Artificial Sequence
  Description of Artificial Sequence: Synthetic oligonucleotide
agcctcaatacatttaaaaa

SEQ ID NO: 25812 - DNA, 20 bp, Artificial Sequence
  Description of Artificial Sequence: Synthetic oligonucleotide
aagcctcaatacatttaaaa

SEQ ID NO: 25813 - DNA, 20 bp, Artificial Sequence
  Description of Artificial Sequence: Synthetic oligonucleotide
aaagcctcaatacatttaaa

SEQ ID NO: 25814 - DNA, 20 bp, Artificial Sequence
  Description of Artificial Sequence: Synthetic oligonucleotide
gaaagcctcaatacatttaa

SEQ ID NO: 25815 - DNA, 20 bp, Artificial Sequence
  Description of Artificial Sequence: Synthetic oligonucleotide
agaaagcctcaatacattta

SEQ ID NO: 25816 - DNA, 20 bp, Artificial Sequence
  Description of Artificial Sequence: Synthetic oligonucleotide
aagaaagcctcaatacattt

SEQ ID NO: 25817 - DNA, 20 bp, Artificial Sequence
  Description of Artificial Sequence: Synthetic oligonucleotide
caagaaagcctcaatacatt

SEQ ID NO: 25818 - DNA, 20 bp, Artificial Sequence
  Description of Artificial Sequence: Synthetic oligonucleotide
ccaagaaagcctcaatacat

SEQ ID NO: 25819 - DNA, 20 bp, Artificial Sequence
  Description of Artificial Sequence: Synthetic oligonucleotide
accaagaaagcctcaataca

SEQ ID NO: 25820 - DNA, 20 bp, Artificial Sequence
  Description of Artificial Sequence: Synthetic oligonucleotide
caccaagaaagcctcaatac

SEQ ID NO: 25821 - DNA, 20 bp, Artificial Sequence
  Description of Artificial Sequence: Synthetic oligonucleotide
ccaccaagaaagcctcaata

SEQ ID NO: 25822 - DNA, 20 bp, Artificial Sequence
  Description of Artificial Sequence: Synthetic oligonucleotide
tccaccaagaaagcctcaat

SEQ ID NO: 25823 - DNA, 20 bp, Artificial Sequence
  Description of Artificial Sequence: Synthetic oligonucleotide
gtccaccaagaaagcctcaa

SEQ ID NO: 25824 - DNA, 20 bp, Artificial Sequence
  Description of Artificial Sequence: Synthetic oligonucleotide
agtccaccaagaaagcctca

SEQ ID NO: 25825 - DNA, 20 bp, Artificial Sequence
  Description of Artificial Sequence: Synthetic oligonucleotide
tagtccaccaagaaagcctc

SEQ ID NO: 25826 - DNA, 20 bp, Artificial Sequence
  Description of Artificial Sequence: Synthetic oligonucleotide
ctagtccaccaagaaagcct

SEQ ID NO: 25827 - DNA, 20 bp, Artificial Sequence
  Description of Artificial Sequence: Synthetic oligonucleotide
actagtccaccaagaaagcc

SEQ ID NO: 25828 - DNA, 20 bp, Artificial Sequence
  Description of Artificial Sequence: Synthetic oligonucleotide
tactagtccaccaagaaagc

SEQ ID NO: 25829 - DNA, 20 bp, Artificial Sequence
  Description of Artificial Sequence: Synthetic oligonucleotide
atactagtccaccaagaaag

SEQ ID NO: 25830 - DNA, 20 bp, Artificial Sequence
  Description of Artificial Sequence: Synthetic oligonucleotide
tatactagtccaccaagaaa

SEQ ID NO: 25831 - DNA, 20 bp, Artificial Sequence
  Description of Artificial Sequence: Synthetic oligonucleotide
ctatactagtccaccaagaa

SEQ ID NO: 25832 - DNA, 20 bp, Artificial Sequence
  Description of Artificial Sequence: Synthetic oligonucleotide
actatactagtccaccaaga

SEQ ID NO: 25833 - DNA, 20 bp, Artificial Sequence
  Description of Artificial Sequence: Synthetic oligonucleotide
tactatactagtccaccaag

SEQ ID NO: 25834 - DNA, 20 bp, Artificial Sequence
  Description of Artificial Sequence: Synthetic oligonucleotide
atactatactagtccaccaa

SEQ ID NO: 25835 - DNA, 20 bp, Artificial Sequence
  Description of Artificial Sequence: Synthetic oligonucleotide
tatactatactagtccacca

SEQ ID NO: 25836 - DNA, 20 bp, Artificial Sequence
  Description of Artificial Sequence: Synthetic oligonucleotide
gtatactatactagtccacc

SEQ ID NO: 25837 - DNA, 20 bp, Artificial Sequence
  Description of Artificial Sequence: Synthetic oligonucleotide
cgtatactatactagtccac

SEQ ID NO: 25838 - DNA, 20 bp, Artificial Sequence
  Description of Artificial Sequence: Synthetic oligonucleotide
ccgtatactatactagtcca

SEQ ID NO: 25839 - DNA, 20 bp, Artificial Sequence
  Description of Artificial Sequence: Synthetic oligonucleotide
accgtatactatactagtcc

SEQ ID NO: 25840 - DNA, 20 bp, Artificial Sequence
  Description of Artificial Sequence: Synthetic oligonucleotide
gaccgtatactatactagtc

SEQ ID NO: 25841 - DNA, 20 bp, Artificial Sequence
  Description of Artificial Sequence: Synthetic oligonucleotide
tgaccgtatactatactagt

SEQ ID NO: 25842 - DNA, 20 bp, Artificial Sequence
  Description of Artificial Sequence: Synthetic oligonucleotide
ctgaccgtatactatactag

SEQ ID NO: 25843 - DNA, 20 bp, Artificial Sequence
  Description of Artificial Sequence: Synthetic oligonucleotide
actgaccgtatactatacta

SEQ ID NO: 25844 - DNA, 20 bp, Artificial Sequence
  Description of Artificial Sequence: Synthetic oligonucleotide
aactgaccgtatactatact

SEQ ID NO: 25845 - DNA, 20 bp, Artificial Sequence
  Description of Artificial Sequence: Synthetic oligonucleotide
taactgaccgtatactatac

SEQ ID NO: 25846 - DNA, 20 bp, Artificial Sequence
  Description of Artificial Sequence: Synthetic oligonucleotide
ataactgaccgtatactata

SEQ ID NO: 25847 - DNA, 20 bp, Artificial Sequence
  Description of Artificial Sequence: Synthetic oligonucleotide
cataactgaccgtatactat

SEQ ID NO: 25848 - DNA, 20 bp, Artificial Sequence
  Description of Artificial Sequence: Synthetic oligonucleotide
acataactgaccgtatacta

SEQ ID NO: 25849 - DNA, 20 bp, Artificial Sequence
  Description of Artificial Sequence: Synthetic oligonucleotide
gacataactgaccgtatact

SEQ ID NO: 25850 - DNA, 20 bp, Artificial Sequence
  Description of Artificial Sequence: Synthetic oligonucleotide
tgacataactgaccgtatac

SEQ ID NO: 25851 - DNA, 20 bp, Artificial Sequence
  Description of Artificial Sequence: Synthetic oligonucleotide
ttgacataactgaccgtata

SEQ ID NO: 25852 - DNA, 20 bp, Artificial Sequence
  Description of Artificial Sequence: Synthetic oligonucleotide
attgacataactgaccgtat

SEQ ID NO: 25853 - DNA, 20 bp, Artificial Sequence
  Description of Artificial Sequence: Synthetic oligonucleotide
cattgacataactgaccgta

SEQ ID NO: 25854 - DNA, 20 bp, Artificial Sequence
  Description of Artificial Sequence: Synthetic oligonucleotide
acattgacataactgaccgt

SEQ ID NO: 25855 - DNA, 20 bp, Artificial Sequence
  Description of Artificial Sequence: Synthetic oligonucleotide
aacattgacataactgaccg

SEQ ID NO: 25856 - DNA, 20 bp, Artificial Sequence
  Description of Artificial Sequence: Synthetic oligonucleotide
aaacattgacataactgacc

SEQ ID NO: 25857 - DNA, 20 bp, Artificial Sequence
  Description of Artificial Sequence: Synthetic oligonucleotide
gaaacattgacataactgac

SEQ ID NO: 25858 - DNA, 20 bp, Artificial Sequence
  Description of Artificial Sequence: Synthetic oligonucleotide
tgaaacattgacataactga

SEQ ID NO: 25859 - DNA, 20 bp, Artificial Sequence
  Description of Artificial Sequence: Synthetic oligonucleotide
atgaaacattgacataactg

SEQ ID NO: 25860 - DNA, 20 bp, Artificial Sequence
  Description of Artificial Sequence: Synthetic oligonucleotide
catgaaacattgacataact

SEQ ID NO: 25861 - DNA, 20 bp, Artificial Sequence
  Description of Artificial Sequence: Synthetic oligonucleotide
ccatgaaacattgacataac

SEQ ID NO: 25862 - DNA, 20 bp, Artificial Sequence
  Description of Artificial Sequence: Synthetic oligonucleotide
accatgaaacattgacataa

SEQ ID NO: 25863 - DNA, 20 bp, Artificial Sequence
  Description of Artificial Sequence: Synthetic oligonucleotide
gaccatgaaacattgacata

SEQ ID NO: 25864 - DNA, 20 bp, Artificial Sequence
  Description of Artificial Sequence: Synthetic oligonucleotide
tgaccatgaaacattgacat

SEQ ID NO: 25865 - DNA, 20 bp, Artificial Sequence
  Description of Artificial Sequence: Synthetic oligonucleotide
ttgaccatgaaacattgaca

SEQ ID NO: 25866 - DNA, 20 bp, Artificial Sequence
  Description of Artificial Sequence: Synthetic oligonucleotide
attgaccatgaaacattgac

SEQ ID NO: 25867 - DNA, 20 bp, Artificial Sequence
  Description of Artificial Sequence: Synthetic oligonucleotide
tattgaccatgaaacattga

SEQ ID NO: 25868 - DNA, 20 bp, Artificial Sequence
  Description of Artificial Sequence: Synthetic oligonucleotide
ttattgaccatgaaacattg

SEQ ID NO: 25869 - DNA, 20 bp, Artificial Sequence
  Description of Artificial Sequence: Synthetic oligonucleotide
tttattgaccatgaaacatt

SEQ ID NO: 25870 - DNA, 20 bp, Artificial Sequence
  Description of Artificial Sequence: Synthetic oligonucleotide
ttttattgaccatgaaacat

SEQ ID NO: 25871 - DNA, 20 bp, Artificial Sequence
  Description of Artificial Sequence: Synthetic oligonucleotide
tttttattgaccatgaaaca

SEQ ID NO: 25872 - DNA, 20 bp, Artificial Sequence
  Description of Artificial Sequence: Synthetic oligonucleotide
ctttttattgaccatgaaac

SEQ ID NO: 25873 - DNA, 20 bp, Artificial Sequence
  Description of Artificial Sequence: Synthetic oligonucleotide
cctttttattgaccatgaaa

SEQ ID NO: 25874 - DNA, 20 bp, Artificial Sequence
  Description of Artificial Sequence: Synthetic oligonucleotide
tcctttttattgaccatgaa

SEQ ID NO: 25875 - DNA, 20 bp, Artificial Sequence
  Description of Artificial Sequence: Synthetic oligonucleotide
ttcctttttattgaccatga

SEQ ID NO: 25876 - DNA, 20 bp, Artificial Sequence
  Description of Artificial Sequence: Synthetic oligonucleotide
cttcctttttattgaccatg

SEQ ID NO: 25877 - DNA, 20 bp, Artificial Sequence
  Description of Artificial Sequence: Synthetic oligonucleotide
acttcctttttattgaccat

SEQ ID NO: 25878 - DNA, 20 bp, Artificial Sequence
  Description of Artificial Sequence: Synthetic oligonucleotide
aacttcctttttattgacca

SEQ ID NO: 25879 - DNA, 20 bp, Artificial Sequence
  Description of Artificial Sequence: Synthetic oligonucleotide
caacttcctttttattgacc

SEQ ID NO: 25880 - DNA, 20 bp, Artificial Sequence
  Description of Artificial Sequence: Synthetic oligonucleotide
gcaacttcctttttattgac

SEQ ID NO: 25881 - DNA, 20 bp, Artificial Sequence
  Description of Artificial Sequence: Synthetic oligonucleotide
tgcaacttcctttttattga

SEQ ID NO: 25882 - DNA, 20 bp, Artificial Sequence
  Description of Artificial Sequence: Synthetic oligonucleotide
ttgcaacttcctttttattg

SEQ ID NO: 25883 - DNA, 20 bp, Artificial Sequence
  Description of Artificial Sequence: Synthetic oligonucleotide
tttgcaacttcctttttatt

SEQ ID NO: 25884 - DNA, 20 bp, Artificial Sequence
  Description of Artificial Sequence: Synthetic oligonucleotide
atttgcaacttcctttttat

SEQ ID NO: 25885 - DNA, 20 bp, Artificial Sequence
  Description of Artificial Sequence: Synthetic oligonucleotide
aatttgcaacttccttttta

SEQ ID NO: 25886 - DNA, 20 bp, Artificial Sequence
  Description of Artificial Sequence: Synthetic oligonucleotide
caatttgcaacttccttttt

SEQ ID NO: 25887 - DNA, 20 bp, Artificial Sequence
  Description of Artificial Sequence: Synthetic oligonucleotide
acaatttgcaacttcctttt

SEQ ID NO: 25888 - DNA, 20 bp, Artificial Sequence
  Description of Artificial Sequence: Synthetic oligonucleotide
cacaatttgcaacttccttt

SEQ ID NO: 25889 - DNA, 20 bp, Artificial Sequence
  Description of Artificial Sequence: Synthetic oligonucleotide
tcacaatttgcaacttcctt

SEQ ID NO: 25890 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gagacuccaacuuaaggcauu

SEQ ID NO: 25891 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agacuccaacuuaaggcaauu

SEQ ID NO: 25892 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccaacuuaaggcaacagcauu

SEQ ID NO: 25893 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
caacuuaaggcaacagcaauu

SEQ ID NO: 25894 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acuuaaggcaacagcaugauu

SEQ ID NO: 25895 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcaacagcaugggugaauauu

SEQ ID NO: 25896 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aacagcaugggugaauaaauu

SEQ ID NO: 25897 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acagcaugggugaauaagauu

SEQ ID NO: 25898 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cagcaugggugaauaaggauu

SEQ ID NO: 25899 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agcaugggugaauaagggauu

SEQ ID NO: 25900 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
auaagggcuuccuguggaauu

SEQ ID NO: 25901 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcaaaaccuggugcuugaauu

SEQ ID NO: 25902 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
caaaaccuggugcuugagauu

SEQ ID NO: 25903 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ggugcuugagcacuggccauu

SEQ ID NO: 25904 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aggcaggccuuacagaucauu

SEQ ID NO: 25905 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aggccuuacagaucucuuauu

SEQ ID NO: 25906 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ggccuuacagaucucuuaauu

SEQ ID NO: 25907 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gccuuacagaucucuuacauu

SEQ ID NO: 25908 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuuacagaucucuuacacauu

SEQ ID NO: 25909 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cagaucucuuacacucguauu

SEQ ID NO: 25910 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agaucucuuacacucgugauu

SEQ ID NO: 25911 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gaucucuuacacucguggauu

SEQ ID NO: 25912 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aucucuuacacucgugguauu

SEQ ID NO: 25913 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucucuuacacucguggugauu

SEQ ID NO: 25914 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cucuuacacucgugguggauu

SEQ ID NO: 25915 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uacacucguggugggaagauu

SEQ ID NO: 25916 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acacucguggugggaagaauu

SEQ ID NO: 25917 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acucguggugggaagaguauu

SEQ ID NO: 25918 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cguggugggaagaguuuaauu

SEQ ID NO: 25919 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gugaaacugggguggaauauu

SEQ ID NO: 25920 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uggaauuggguguccacgauu

SEQ ID NO: 25921 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gaauuggguguccacguaauu

SEQ ID NO: 25922 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aauuggguguccacguauauu

SEQ ID NO: 25923 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
auuggguguccacguaugauu

SEQ ID NO: 25924 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ggguguccacguauguucauu

SEQ ID NO: 25925 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gguguccacguauguuccauu

SEQ ID NO: 25926 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccacguauguucccuuuuauu

SEQ ID NO: 25927 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cacguauguucccuuuugauu

SEQ ID NO: 25928 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
guauguucccuuuugccuauu

SEQ ID NO: 25929 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uguucccuuuugccuuacauu

SEQ ID NO: 25930 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucccuuuugccuuacuauauu

SEQ ID NO: 25931 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uugccuuacuauauguucauu

SEQ ID NO: 25932 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuuacuauauguucugucauu

SEQ ID NO: 25933 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uuacuauauguucugucaauu

SEQ ID NO: 25934 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uucaucuuacaacuuguaauu

SEQ ID NO: 25935 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aacuuguagggcugguguauu

SEQ ID NO: 25936 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uguagggcugguguuaacauu

SEQ ID NO: 25937 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcugguguuaacuuacgaauu

SEQ ID NO: 25938 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ugguguuaacuuacgacuauu

SEQ ID NO: 25939 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gguguuaacuuacgacuuauu

SEQ ID NO: 25940 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
guguuaacuuacgacuucauu

SEQ ID NO: 25941 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
guuaacuuacgacuucacauu

SEQ ID NO: 25942 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uuaacuuacgacuucacuauu

SEQ ID NO: 25943 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acuuacgacuucacuaacauu

SEQ ID NO: 25944 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuuacgacuucacuaacuauu

SEQ ID NO: 25945 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uacgacuucacuaacuguauu

SEQ ID NO: 25946 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aaagcagccuaucucaguauu

SEQ ID NO: 25947 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agccuaucucaguacuauauu

SEQ ID NO: 25948 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gccuaucucaguacuauuauu

SEQ ID NO: 25949 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuaucucaguacuauuucauu

SEQ ID NO: 25950 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aucucaguacuauuucuaauu

SEQ ID NO: 25951 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucucaguacuauuucuaaauu

SEQ ID NO: 25952 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
guacuauuucuaaagaccauu

SEQ ID NO: 25953 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uuucuaaagaccugauuaauu

SEQ ID NO: 25954 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uucuaaagaccugauuacauu

SEQ ID NO: 25955 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gaccugauuacauauaugauu

SEQ ID NO: 25956 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cugauuacauauaugaguauu

SEQ ID NO: 25957 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ugauuacauauaugagugauu

SEQ ID NO: 25958 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uauaugagugggaccaaaauu

SEQ ID NO: 25959 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uaugagugggaccaaaagauu

SEQ ID NO: 25960 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ugagugggaccaaaaguaauu

SEQ ID NO: 25961 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agugggaccaaaaguaccauu

SEQ ID NO: 25962 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gugggaccaaaaguaccgauu

SEQ ID NO: 25963 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ggaccaaaaguaccgaguauu

SEQ ID NO: 25964 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gaccaaaaguaccgaguuauu

SEQ ID NO: 25965 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
caaaaguaccgaguucaaauu

SEQ ID NO: 25966 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccgaguucaacaacaccgauu

SEQ ID NO: 25967 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aacaacaccgucucuuguauu

SEQ ID NO: 25968 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acaacaccgucucuuguaauu

SEQ ID NO: 25969 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
caccgucucuuguagcaaauu

SEQ ID NO: 25970 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cgucucuuguagcaaucgauu

SEQ ID NO: 25971 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucuuguagcaaucggccaauu

SEQ ID NO: 25972 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uagcaaucggccacauugauu

SEQ ID NO: 25973 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
agcaaucggccacauugcauu

SEQ ID NO: 25974 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcaaucggccacauugccauu

SEQ ID NO: 25975 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
caaucggccacauugccuauu

SEQ ID NO: 25976 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aucggccacauugccuuaauu

SEQ ID NO: 25977 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cggccacauugccuuacuauu

SEQ ID NO: 25978 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccgcgguugguucuuccuauu

SEQ ID NO: 25979 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcgguugguucuuccuugauu

SEQ ID NO: 25980 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gguugguucuuccuugcuauu

SEQ ID NO: 25981 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuuccuugcucuacucaaauu

SEQ ID NO: 25982 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuucucucugacucucgaauu

SEQ ID NO: 25983 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cucugacucucgacuuguauu

SEQ ID NO: 25984 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cugacucucgacuuguguauu

SEQ ID NO: 25985 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ugacucucgacuuguguuauu

SEQ ID NO: 25986 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acucucgacuuguguuccauu

SEQ ID NO: 25987 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucucgacuuguguuccccauu

SEQ ID NO: 25988 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cucgacuuguguuccccgauu

SEQ ID NO: 25989 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucgacuuguguuccccgcauu

SEQ ID NO: 25990 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cgacuuguguuccccgcuauu

SEQ ID NO: 25991 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gacuuguguuccccgcucauu

SEQ ID NO: 25992 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
acuuguguuccccgcuccauu

SEQ ID NO: 25993 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccuccccuuucacucaauauu

SEQ ID NO: 25994 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuccccuuucacucaauuauu

SEQ ID NO: 25995 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ccccuuucacucaauucuauu

SEQ ID NO: 25996 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cccuuucacucaauucucauu

SEQ ID NO: 25997 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucuccuuuucucguaaacauu

SEQ ID NO: 25998 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuccuuuucucguaaacuauu

SEQ ID NO: 25999 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uccuuuucucguaaacuuauu

SEQ ID NO: 26000 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuuuucucguaaacuuugauu

SEQ ID NO: 26001 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uuuucucguaaacuuugcauu

SEQ ID NO: 26002 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uucucguaaacuuugccgauu

SEQ ID NO: 26003 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucucguaaacuuugccgcauu

SEQ ID NO: 26004 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cucguaaacuuugccgccauu

SEQ ID NO: 26005 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
ucguaaacuuugccgccuauu

SEQ ID NO: 26006 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
guaaacuuugccgccuauauu

SEQ ID NO: 26007 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
uaaacuuugccgccuaugauu

SEQ ID NO: 26008 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
aacuuugccgccuaugagauu

SEQ ID NO: 26009 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cgccuaugagcagccacaauu

SEQ ID NO: 26010 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
cuaugagcagccacauugauu

SEQ ID NO: 26011 - RNA, 21 nt, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
gcagccacauugccuuacauu

SEQ ID NO: 26012 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugccuuaaguuggagucucuu

SEQ ID NO: 26013 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uugccuuaaguuggagucuuu

SEQ ID NO: 26014 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugcuguugccuuaaguugguu

SEQ ID NO: 26015 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uugcuguugccuuaaguuguu

SEQ ID NO: 26016 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaugcuguugccuuaaguuu

SEQ ID NO: 26017 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauucacccaugcuguugcuu

SEQ ID NO: 26018 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuuauucacccaugcuguuuu

SEQ ID NO: 26019 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucuuauucacccaugcuguuu

SEQ ID NO: 26020 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uccuuauucacccaugcuguu

SEQ ID NO: 26021 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucccuuauucacccaugcuuu

SEQ ID NO: 26022 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuccacaggaagcccuuauuu

SEQ ID NO: 26023 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uucaagcaccagguuuugcuu

SEQ ID NO: 26024 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucucaagcaccagguuuuguu

SEQ ID NO: 26025 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggccagugcucaagcaccuu

SEQ ID NO: 26026 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugaucuguaaggccugccuuu

SEQ ID NO: 26027 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaagagaucuguaaggccuuu

SEQ ID NO: 26028 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuaagagaucuguaaggccuu

SEQ ID NO: 26029 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguaagagaucuguaaggcuu

SEQ ID NO: 26030 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguguaagagaucuguaaguu

SEQ ID NO: 26031 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacgaguguaagagaucuguu

SEQ ID NO: 26032 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucacgaguguaagagaucuuu

SEQ ID NO: 26033 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uccacgaguguaagagaucuu

SEQ ID NO: 26034 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaccacgaguguaagagauuu

SEQ ID NO: 26035 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaccacgaguguaagagauu

SEQ ID NO: 26036 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uccaccacgaguguaagaguu

SEQ ID NO: 26037 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucuucccaccacgaguguauu

SEQ ID NO: 26038 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uucuucccaccacgaguguuu

SEQ ID NO: 26039 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacucuucccaccacgaguuu

SEQ ID NO: 26040 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuaaacucuucccaccacguu

SEQ ID NO: 26041 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauuccaccccaguuucacuu

SEQ ID NO: 26042 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucguggacacccaauuccauu

SEQ ID NO: 26043 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuacguggacacccaauucuu

SEQ ID NO: 26044 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauacguggacacccaauuuu

SEQ ID NO: 26045 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucauacguggacacccaauuu

SEQ ID NO: 26046 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugaacauacguggacacccuu

SEQ ID NO: 26047 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggaacauacguggacaccuu

SEQ ID NO: 26048 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaaaagggaacauacgugguu

SEQ ID NO: 26049 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaaaagggaacauacguguu

SEQ ID NO: 26050 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaggcaaaagggaacauacuu

SEQ ID NO: 26051 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguaaggcaaaagggaacauu

SEQ ID NO: 26052 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauaguaaggcaaaagggauu

SEQ ID NO: 26053 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugaacauauaguaaggcaauu

SEQ ID NO: 26054 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugacagaacauauaguaaguu

SEQ ID NO: 26055 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uugacagaacauauaguaauu

SEQ ID NO: 26056 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuacaaguuguaagaugaauu

SEQ ID NO: 26057 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacaccagcccuacaaguuuu

SEQ ID NO: 26058 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguuaacaccagcccuacauu

SEQ ID NO: 26059 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uucguaaguuaacaccagcuu

SEQ ID NO: 26060 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uagucguaaguuaacaccauu

SEQ ID NO: 26061 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaagucguaaguuaacaccuu

SEQ ID NO: 26062 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugaagucguaaguuaacacuu

SEQ ID NO: 26063 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugugaagucguaaguuaacuu

SEQ ID NO: 26064 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uagugaagucguaaguuaauu

SEQ ID NO: 26065 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguuagugaagucguaaguuu

SEQ ID NO: 26066 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaguuagugaagucguaaguu

SEQ ID NO: 26067 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacaguuagugaagucguauu

SEQ ID NO: 26068 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacugagauaggcugcuuuuu

SEQ ID NO: 26069 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauaguacugagauaggcuuu

SEQ ID NO: 26070 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaauaguacugagauaggcuu

SEQ ID NO: 26071 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugaaauaguacugagauaguu

SEQ ID NO: 26072 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuagaaauaguacugagauuu

SEQ ID NO: 26073 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuuagaaauaguacugagauu

SEQ ID NO: 26074 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggucuuuagaaauaguacuu

SEQ ID NO: 26075 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuaaucaggucuuuagaaauu

SEQ ID NO: 26076 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguaaucaggucuuuagaauu

SEQ ID NO: 26077 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucauauauguaaucaggucuu

SEQ ID NO: 26078 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacucauauauguaaucaguu

SEQ ID NO: 26079 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucacucauauauguaaucauu

SEQ ID NO: 26080 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuuuggucccacucauauauu

SEQ ID NO: 26081 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucuuuuggucccacucauauu

SEQ ID NO: 26082 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuacuuuuggucccacucauu

SEQ ID NO: 26083 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugguacuuuuggucccacuuu

SEQ ID NO: 26084 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucgguacuuuuggucccacuu

SEQ ID NO: 26085 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacucgguacuuuugguccuu

SEQ ID NO: 26086 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaacucgguacuuuuggucuu

SEQ ID NO: 26087 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuugaacucgguacuuuuguu

SEQ ID NO: 26088 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucgguguuguugaacucgguu

SEQ ID NO: 26089 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacaagagacgguguuguuuu

SEQ ID NO: 26090 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuacaagagacgguguuguuu

SEQ ID NO: 26091 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuugcuacaagagacgguguu

SEQ ID NO: 26092 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucgauugcuacaagagacguu

SEQ ID NO: 26093 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuggccgauugcuacaagauu

SEQ ID NO: 26094 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaauguggccgauugcuauu

SEQ ID NO: 26095 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugcaauguggccgauugcuuu

SEQ ID NO: 26096 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggcaauguggccgauugcuu

SEQ ID NO: 26097 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaggcaauguggccgauuguu

SEQ ID NO: 26098 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuaaggcaauguggccgauuu

SEQ ID NO: 26099 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaguaaggcaauguggccguu

SEQ ID NO: 26100 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaggaagaaccaaccgcgguu

SEQ ID NO: 26101 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaaggaagaaccaaccgcuu

SEQ ID NO: 26102 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uagcaaggaagaaccaaccuu

SEQ ID NO: 26103 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuugaguagagcaaggaaguu

SEQ ID NO: 26104 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uucgagagucagagagaaguu

SEQ ID NO: 26105 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacaagucgagagucagaguu

SEQ ID NO: 26106 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uacacaagucgagagucaguu

SEQ ID NO: 26107 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaacacaagucgagagucauu

SEQ ID NO: 26108 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggaacacaagucgagaguuu

SEQ ID NO: 26109 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggggaacacaagucgagauu

SEQ ID NO: 26110 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucggggaacacaagucgaguu

SEQ ID NO: 26111 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugcggggaacacaagucgauu

SEQ ID NO: 26112 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uagcggggaacacaagucguu

SEQ ID NO: 26113 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugagcggggaacacaagucuu

SEQ ID NO: 26114 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggagcggggaacacaaguuu

SEQ ID NO: 26115 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauugagugaaaggggagguu

SEQ ID NO: 26116 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaauugagugaaaggggaguu

SEQ ID NO: 26117 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uagaauugagugaaagggguu

SEQ ID NO: 26118 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugagaauugagugaaaggguu

SEQ ID NO: 26119 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguuuacgagaaaaggagauu

SEQ ID NO: 26120 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaguuuacgagaaaaggaguu

SEQ ID NO: 26121 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaaguuuacgagaaaaggauu

SEQ ID NO: 26122 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaaaguuuacgagaaaaguu

SEQ ID NO: 26123 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugcaaaguuuacgagaaaauu

SEQ ID NO: 26124 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucggcaaaguuuacgagaauu

SEQ ID NO: 26125 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ugcggcaaaguuuacgagauu

SEQ ID NO: 26126 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uggcggcaaaguuuacgaguu

SEQ ID NO: 26127 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uaggcggcaaaguuuacgauu

SEQ ID NO: 26128 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uauaggcggcaaaguuuacuu

SEQ ID NO: 26129 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucauaggcggcaaaguuuauu

SEQ ID NO: 26130 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucucauaggcggcaaaguuuu

SEQ ID NO: 26131 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uuguggcugcucauaggcguu

SEQ ID NO: 26132 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
ucaauguggcugcucauaguu

SEQ ID NO: 26133 - RNA, 21 nt, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
uguaaggcaauguggcugcuu

SEQ ID NO: 26134 - RNA, 21 nt, Artificial Sequence
  Description of Artificial Sequence: Synthetic oligonucleotide
aaguuggagucucccugauuu

SEQ ID NO: 26135 - RNA, 22 nt, Artificial Sequence
  Description of Artificial Sequence: Synthetic oligonucleotide
uaaguuggagucucccugauau

SEQ ID NO: 26136 - RNA, 21 nt, Artificial Sequence
  Description of Artificial Sequence: Synthetic oligonucleotide
uuaaguuggagucucccugau

SEQ ID NO: 26137 - RNA, 21 nt, Artificial Sequence
  Description of Artificial Sequence: Synthetic oligonucleotide
cuuaaguuggagucucccuga

SEQ ID NO: 26138 - RNA, 21 nt, Artificial Sequence
  Description of Artificial Sequence: Synthetic oligonucleotide
ccuuaaguuggagucucccug

SEQ ID NO: 26139 - RNA, 21 nt, Artificial Sequence
  Description of Artificial Sequence: Synthetic oligonucleotide
gccuuaaguuggagucucccu

SEQ ID NO: 26140 - RNA, 21 nt, Artificial Sequence
  Description of Artificial Sequence: Synthetic oligonucleotide
ugccuuaaguuggagucuccc

SEQ ID NO: 26141 - RNA, 21 nt, Artificial Sequence
  Description of Artificial Sequence: Synthetic oligonucleotide
uugccuuaaguuggagucucc

SEQ ID NO: 26142 - RNA, 21 nt, Artificial Sequence
  Description of Artificial Sequence: Synthetic oligonucleotide
guugccuuaaguuggagucuc

SEQ ID NO: 26143 - RNA, 21 nt, Artificial Sequence
  Description of Artificial Sequence: Synthetic oligonucleotide
uguugccuuaaguuggagucu

SEQ ID NO: 26144 - RNA, 21 nt, Artificial Sequence
  Description of Artificial Sequence: Synthetic oligonucleotide
cuguugccuuaaguuggaguc

SEQ ID NO: 26145 - RNA, 21 nt, Artificial Sequence
  Description of Artificial Sequence: Synthetic oligonucleotide
gcuguugccuuaaguuggagu

SEQ ID NO: 26146 - RNA, 21 nt, Artificial Sequence
  Description of Artificial Sequence: Synthetic oligonucleotide
ugcuguugccuuaaguuggag

SEQ ID NO: 26147 - RNA, 21 nt, Artificial Sequence
  Description of Artificial Sequence: Synthetic oligonucleotide
augcuguugccuuaaguugga

SEQ ID NO: 26148 - RNA, 21 nt, Artificial Sequence
  Description of Artificial Sequence: Synthetic oligonucleotide
caugcuguugccuuaaguugg

SEQ ID NO: 26149 - RNA, 21 nt, Artificial Sequence
  Description of Artificial Sequence: Synthetic oligonucleotide
ccaugcuguugccuuaaguug

SEQ ID NO: 26150 - RNA, 21 nt, Artificial Sequence
  Description of Artificial Sequence: Synthetic oligonucleotide
cccaugcuguugccuuaaguu

SEQ ID NO: 26151 - RNA, 21 nt, Artificial Sequence
  Description of Artificial Sequence: Synthetic oligonucleotide
acccaugcuguugccuuaagu

SEQ ID NO: 26152 - RNA, 21 nt, Artificial Sequence
  Description of Artificial Sequence: Synthetic oligonucleotide
cacccaugcuguugccuuaag

SEQ ID NO: 26153 - RNA, 21 nt, Artificial Sequence
  Description of Artificial Sequence: Synthetic oligonucleotide
ucacccaugcuguugccuuaa

SEQ ID NO: 26154 - RNA, 21 nt, Artificial Sequence
  Description of Artificial Sequence: Synthetic oligonucleotide
uucacccaugcuguugccuua

SEQ ID NO: 26155 - RNA, 21 nt, Artificial Sequence
  Description of Artificial Sequence: Synthetic oligonucleotide
auucacccaugcuguugccuu

SEQ ID NO: 26156 - RNA, 21 nt, Artificial Sequence
  Description of Artificial Sequence: Synthetic oligonucleotide
uauucacccaugcuguugccu

SEQ ID NO: 26157 - RNA, 21 nt, Artificial Sequence
  Description of Artificial Sequence: Synthetic oligonucleotide
uuauucacccaugcuguugcc

SEQ ID NO: 26158 - RNA, 21 nt, Artificial Sequence
  Description of Artificial Sequence: Synthetic oligonucleotide
cuuauucacccaugcuguugc

SEQ ID NO: 26159 - RNA, 21 nt, Artificial Sequence
  Description of Artificial Sequence: Synthetic oligonucleotide
ccuuauucacccaugcuguug

SEQ ID NO: 26160 - RNA, 21 nt, Artificial Sequence
  Description of Artificial Sequence: Synthetic oligonucleotide
cccuuauucacccaugcuguu

SEQ ID NO: 26161 - RNA, 21 nt, Artificial Sequence
  Description of Artificial Sequence: Synthetic oligonucleotide
gcccuuauucacccaugcugu

SEQ ID NO: 26162 - RNA, 21 nt, Artificial Sequence
  Description of Artificial Sequence: Synthetic oligonucleotide
agcccuuauucacccaugcug

SEQ ID NO: 26163 - RNA, 21 nt, Artificial Sequence
  Description of Artificial Sequence: Synthetic oligonucleotide
aagcccuuauucacccaugcu

SEQ ID NO: 26164 - RNA, 21 nt, Artificial Sequence
  Description of Artificial Sequence: Synthetic oligonucleotide
gaagcccuuauucacccaugc

SEQ ID NO: 26165 - RNA, 21 nt, Artificial Sequence
  Description of Artificial Sequence: Synthetic oligonucleotide
ggaagcccuuauucacccaug

SEQ ID NO: 26166 - RNA, 21 nt, Artificial Sequence
  Description of Artificial Sequence: Synthetic oligonucleotide
aggaagcccuuauucacccau

SEQ ID NO: 26167 - RNA, 21 nt, Artificial Sequence
  Description of Artificial Sequence: Synthetic oligonucleotide
caggaagcccuuauucaccca

SEQ ID NO: 26168 - RNA, 21 nt, Artificial Sequence
  Description of Artificial Sequence: Synthetic oligonucleotide
acaggaagcccuuauucaccc

SEQ ID NO: 26169 - RNA, 21 nt, Artificial Sequence
  Description of Artificial Sequence: Synthetic oligonucleotide
cacaggaagcccuuauucacc

SEQ ID NO: 26170 - RNA, 21 nt, Artificial Sequence
  Description of Artificial Sequence: Synthetic oligonucleotide
ccacaggaagcccuuauucac

SEQ ID NO: 26171 - RNA, 21 nt, Artificial Sequence
  Description of Artificial Sequence: Synthetic oligonucleotide
uccacaggaagcccuuauuca

SEQ ID NO: 26172 - RNA, 21 nt, Artificial Sequence
  Description of Artificial Sequence: Synthetic oligonucleotide
guccacaggaagcccuuauuc

SEQ ID NO: 26173 - RNA, 21 nt, Artificial Sequence
  Description of Artificial Sequence: Synthetic oligonucleotide
aguccacaggaagcccuuauu

SEQ ID NO: 26174 - RNA, 21 nt, Artificial Sequence
  Description of Artificial Sequence: Synthetic oligonucleotide
caguccacaggaagcccuuau

SEQ ID NO: 26175 - RNA, 21 nt, Artificial Sequence
  Description of Artificial Sequence: Synthetic oligonucleotide
ccaguccacaggaagcccuua

SEQ ID NO: 26176 - RNA, 21 nt, Artificial Sequence
  Description of Artificial Sequence: Synthetic oligonucleotide
gccaguccacaggaagcccuu

SEQ ID NO: 26177 - RNA, 21 nt, Artificial Sequence
  Description of Artificial Sequence: Synthetic oligonucleotide
ugccaguccacaggaagcccu

SEQ ID NO: 26178 - RNA, 21 nt, Artificial Sequence
  Description of Artificial Sequence: Synthetic oligonucleotide
uugccaguccacaggaagccc

SEQ ID NO: 26179 - RNA, 21 nt, Artificial Sequence
  Description of Artificial Sequence: Synthetic oligonucleotide
auugccaguccacaggaagcc

SEQ ID NO: 26180 - RNA, 21 nt, Artificial Sequence
  Description of Artificial Sequence: Synthetic oligonucleotide
cauugccaguccacaggaagc

SEQ ID NO: 26181 - RNA, 21 nt, Artificial Sequence
  Description of Artificial Sequence: Synthetic oligonucleotide
ucauugccaguccacaggaag

SEQ ID NO: 26182 - RNA, 21 nt, Artificial Sequence
  Description of Artificial Sequence: Synthetic oligonucleotide
cucauugccaguccacaggaa

SEQ ID NO: 26183 - RNA, 21 nt, Artificial Sequence
  Description of Artificial Sequence: Synthetic oligonucleotide
ucucauugccaguccacagga

SEQ ID NO: 26184 - RNA, 21 nt, Artificial Sequence
  Description of Artificial Sequence: Synthetic oligonucleotide
cucucauugccaguccacagg

SEQ ID NO: 26185 - RNA, 21 nt, Artificial Sequence
  Description of Artificial Sequence: Synthetic oligonucleotide
ccucucauugccaguccacag

SEQ ID NO: 26186 - RNA, 21 nt, Artificial Sequence
  Description of Artificial Sequence: Synthetic oligonucleotide
gccucucauugccaguccaca

SEQ ID NO: 26187 - RNA, 21 nt, Artificial Sequence
  Description of Artificial Sequence: Synthetic oligonucleotide
ugccucucauugccaguccac

SEQ ID NO: 26188 - RNA, 21 nt, Artificial Sequence
  Description of Artificial Sequence: Synthetic oligonucleotide
uugccucucauugccagucca

SEQ ID NO: 26189 - RNA, 21 nt, Artificial Sequence
  Description of Artificial Sequence: Synthetic oligonucleotide
uuugccucucauugccagucc

SEQ ID NO: 26190 - RNA, 21 nt, Artificial Sequence
  Description of Artificial Sequence: Synthetic oligonucleotide
uuuugccucucauugccaguc

SEQ ID NO: 26191 - RNA, 21 nt, Artificial Sequence
  Description of Artificial Sequence: Synthetic oligonucleotide
guuuugccucucauugccagu

SEQ ID NO: 26192 - RNA, 21 nt, Artificial Sequence
  Description of Artificial Sequence: Synthetic oligonucleotide
gguuuugccucucauugccag

SEQ ID NO: 26193 - RNA, 21 nt, Artificial Sequence
  Description of Artificial Sequence: Synthetic oligonucleotide
agguuuugccucucauugcca

SEQ ID NO: 26194 - RNA, 21 nt, Artificial Sequence
  Description of Artificial Sequence: Synthetic oligonucleotide
cagguuuugccucucauugcc

SEQ ID NO: 26195 - RNA, 21 nt, Artificial Sequence
  Description of Artificial Sequence: Synthetic oligonucleotide
ccagguuuugccucucauugc

SEQ ID NO: 26196 - RNA, 21 nt, Artificial Sequence
  Description of Artificial Sequence: Synthetic oligonucleotide
accagguuuugccucucauug

SEQ ID NO: 26197 - RNA, 21 nt, Artificial Sequence
  Description of Artificial Sequence: Synthetic oligonucleotide
caccagguuuugccucucauu

SEQ ID NO: 26198 - RNA, 21 nt, Artificial Sequence
  Description of Artificial Sequence: Synthetic oligonucleotide
gcaccagguuuugccucucau

SEQ ID NO: 26199 - RNA, 21 nt, Artificial Sequence
  Description of Artificial Sequence: Synthetic oligonucleotide
agcaccagguuuugccucuca

SEQ ID NO: 26200 - RNA, 21 nt, Artificial Sequence
  Description of Artificial Sequence: Synthetic oligonucleotide
aagcaccagguuuugccucuc

SEQ ID NO: 26201 - RNA, 21 nt, Artificial Sequence
  Description of Artificial Sequence: Synthetic oligonucleotide
caagcaccagguuuugccucu

SEQ ID NO: 26202 - RNA, 21 nt, Artificial Sequence
  Description of Artificial Sequence: Synthetic oligonucleotide
ucaagcaccagguuuugccuc

SEQ ID NO: 26203 - RNA, 21 nt, Artificial Sequence
  Description of Artificial Sequence: Synthetic oligonucleotide
cucaagcaccagguuuugccu

SEQ ID NO: 26204 - RNA, 21 nt, Artificial Sequence
  Description of Artificial Sequence: Synthetic oligonucleotide
gcucaagcaccagguuuugcc

SEQ ID NO: 26205 - RNA, 21 nt, Artificial Sequence
  Description of Artificial Sequence: Synthetic oligonucleotide
ugcucaagcaccagguuuugc

SEQ ID NO: 26206 - RNA, 21 nt, Artificial Sequence
  Description of Artificial Sequence: Synthetic oligonucleotide
gugcucaagcaccagguuuug

SEQ ID NO: 26207 - RNA, 21 nt, Artificial Sequence
  Description of Artificial Sequence: Synthetic oligonucleotide
agugcucaagcaccagguuuu

SEQ ID NO: 26208 - RNA, 21 nt, Artificial Sequence
  Description of Artificial Sequence: Synthetic oligonucleotide
cagugcucaagcaccagguuu

SEQ ID NO: 26209 - RNA, 21 nt, Artificial Sequence
  Description of Artificial Sequence: Synthetic oligonucleotide
ccagugcucaagcaccagguu

SEQ ID NO: 26210 - RNA, 21 nt, Artificial Sequence
  Description of Artificial Sequence: Synthetic oligonucleotide
gccagugcucaagcaccaggu

SEQ ID NO: 26211 - RNA, 21 nt, Artificial Sequence
  Description of Artificial Sequence: Synthetic oligonucleotide
ggccagugcucaagcaccagg

SEQ ID NO: 26212 - RNA, 21 nt, Artificial Sequence
  Description of Artificial Sequence: Synthetic oligonucleotide
gggccagugcucaagcaccag

SEQ ID NO: 26213 - RNA, 21 nt, Artificial Sequence
  Description of Artificial Sequence: Synthetic oligonucleotide
ggggccagugcucaagcacca

SEQ ID NO: 26214 - RNA, 21 nt, Artificial Sequence
  Description of Artificial Sequence: Synthetic oligonucleotide
aggggccagugcucaagcacc

SEQ ID NO: 26215 - RNA, 21 nt, Artificial Sequence
  Description of Artificial Sequence: Synthetic oligonucleotide
uaggggccagugcucaagcac

SEQ ID NO: 26216 - RNA, 21 nt, Artificial Sequence
  Description of Artificial Sequence: Synthetic oligonucleotide
uuaggggccagugcucaagca

SEQ ID NO: 26217 - RNA, 21 nt, Artificial Sequence
  Description of Artificial Sequence: Synthetic oligonucleotide
cuuaggggccagugcucaagc

SEQ ID NO: 26218 - RNA, 21 nt, Artificial Sequence
  Description of Artificial Sequence: Synthetic oligonucleotide
ccuuaggggccagugcucaag

SEQ ID NO: 26219 - RNA, 21 nt, Artificial Sequence
  Description of Artificial Sequence: Synthetic oligonucleotide
gccuuaggggccagugcucaa

SEQ ID NO: 26220 - RNA, 21 nt, Artificial Sequence
  Description of Artificial Sequence: Synthetic oligonucleotide
ugccuuaggggccagugcuca

SEQ ID NO: 26221 - RNA, 21 nt, Artificial Sequence
  Description of Artificial Sequence: Synthetic oligonucleotide
cugccuuaggggccagugcuc

SEQ ID NO: 26222 - RNA, 21 nt, Artificial Sequence
  Description of Artificial Sequence: Synthetic oligonucleotide
ccugccuuaggggccagugcu

SEQ ID NO: 26223 - RNA, 21 nt, Artificial Sequence
  Description of Artificial Sequence: Synthetic oligonucleotide
gccugccuuaggggccagugc

SEQ ID NO: 26224 - RNA, 21 nt, Artificial Sequence
  Description of Artificial Sequence: Synthetic oligonucleotide
ggccugccuuaggggccagug

SEQ ID NO: 26225 - RNA, 21 nt, Artificial Sequence
  Description of Artificial Sequence: Synthetic oligonucleotide
aggccugccuuaggggccagu

SEQ ID NO: 26226 - RNA, 21 nt, Artificial Sequence
  Description of Artificial Sequence: Synthetic oligonucleotide
aaggccugccuuaggggccag

SEQ ID NO: 26227 - RNA, 21 nt, Artificial Sequence
  Description of Artificial Sequence: Synthetic oligonucleotide
uaaggccugccuuaggggcca

SEQ ID NO: 26228 - RNA, 21 nt, Artificial Sequence
  Description of Artificial Sequence: Synthetic oligonucleotide
guaaggccugccuuaggggcc

SEQ ID NO: 26229 - RNA, 21 nt, Artificial Sequence
  Description of Artificial Sequence: Synthetic oligonucleotide
uguaaggccugccuuaggggc

SEQ ID NO: 26230 - RNA, 21 nt, Artificial Sequence
  Description of Artificial Sequence: Synthetic oligonucleotide
cuguaaggccugccuuagggg

SEQ ID NO: 26231 - RNA, 21 nt, Artificial Sequence
  Description of Artificial Sequence: Synthetic oligonucleotide
ucuguaaggccugccuuaggg

SEQ ID NO: 26232 - RNA, 21 nt, Artificial Sequence
  Description of Artificial Sequence: Synthetic oligonucleotide
aucuguaaggccugccuuagg

SEQ ID NO: 26233 - RNA, 21 nt, Artificial Sequence
  Description of Artificial Sequence: Synthetic oligonucleotide
gaucuguaaggccugccuuag

SEQ ID NO: 26234 - RNA, 21 nt, Artificial Sequence
  Description of Artificial Sequence: Synthetic oligonucleotide
agaucuguaaggccugccuua

SEQ ID NO: 26235 - RNA, 21 nt, Artificial Sequence
  Description of Artificial Sequence: Synthetic oligonucleotide
gagaucuguaaggccugccuu

SEQ ID NO: 26236 - RNA, 21 nt, Artificial Sequence
  Description of Artificial Sequence: Synthetic oligonucleotide
agagaucuguaaggccugccu

SEQ ID NO: 26237 - RNA, 21 nt, Artificial Sequence
  Description of Artificial Sequence: Synthetic oligonucleotide
aagagaucuguaaggccugcc

SEQ ID NO: 26238 - RNA, 21 nt, Artificial Sequence
  Description of Artificial Sequence: Synthetic oligonucleotide
uaagagaucuguaaggccugc

SEQ ID NO: 26239 - RNA, 21 nt, Artificial Sequence
  Description of Artificial Sequence: Synthetic oligonucleotide
guaagagaucuguaaggccug

SEQ ID NO: 26240 - RNA, 21 nt, Artificial Sequence
  Description of Artificial Sequence: Synthetic oligonucleotide
uguaagagaucuguaaggccu

SEQ ID NO: 26241 - RNA, 21 nt, Artificial Sequence
  Description of Artificial Sequence: Synthetic oligonucleotide
guguaagagaucuguaaggcc

SEQ ID NO: 26242 - RNA, 21 nt, Artificial Sequence
  Description of Artificial Sequence: Synthetic oligonucleotide
aguguaagagaucuguaaggc

SEQ ID NO: 26243 - RNA, 21 nt, Artificial Sequence
  Description of Artificial Sequence: Synthetic oligonucleotide
gaguguaagagaucuguaagg

SEQ ID NO: 26244 - RNA, 21 nt, Artificial Sequence
  Description of Artificial Sequence: Synthetic oligonucleotide
cgaguguaagagaucuguaag

SEQ ID NO: 26245 - RNA, 21 nt, Artificial Sequence
  Description of Artificial Sequence: Synthetic oligonucleotide
acgaguguaagagaucuguaa

SEQ ID NO: 26246 - RNA, 21 nt, Artificial Sequence
  Description of Artificial Sequence: Synthetic oligonucleotide
cacgaguguaagagaucugua

SEQ ID NO: 26247 - RNA, 21 nt, Artificial Sequence
  Description of Artificial Sequence: Synthetic oligonucleotide
ccacgaguguaagagaucugu

SEQ ID NO: 26248 - RNA, 21 nt, Artificial Sequence
  Description of Artificial Sequence: Synthetic oligonucleotide
accacgaguguaagagaucug

SEQ ID NO: 26249 - RNA, 21 nt, Artificial Sequence
  Description of Artificial Sequence: Synthetic oligonucleotide
caccacgaguguaagagaucu

SEQ ID NO: 26250 - RNA, 21 nt, Artificial Sequence
  Description of Artificial Sequence: Synthetic oligonucleotide
ccaccacgaguguaagagauc

SEQ ID NO: 26251 - RNA, 21 nt, Artificial Sequence
  Description of Artificial Sequence: Synthetic oligonucleotide
cccaccacgaguguaagagau

SEQ ID NO: 26252 - RNA, 21 nt, Artificial Sequence
  Description of Artificial Sequence: Synthetic oligonucleotide
ucccaccacgaguguaagaga

SEQ ID NO: 26253 - RNA, 21 nt, Artificial Sequence
  Description of Artificial Sequence: Synthetic oligonucleotide
uucccaccacgaguguaagag

SEQ ID NO: 26254 - RNA, 21 nt, Artificial Sequence
  Description of Artificial Sequence: Synthetic oligonucleotide
cuucccaccacgaguguaaga

SEQ ID NO: 26255 - RNA, 21 nt, Artificial Sequence
  Description of Artificial Sequence: Synthetic oligonucleotide
ucuucccaccacgaguguaag

SEQ ID NO: 26256 - RNA, 21 nt, Artificial Sequence
  Description of Artificial Sequence: Synthetic oligonucleotide
cucuucccaccacgaguguaa

SEQ ID NO: 26257 - RNA, 21 nt, Artificial Sequence
  Description of Artificial Sequence: Synthetic oligonucleotide
acucuucccaccacgagugua

SEQ ID NO: 26258 - RNA, 21 nt, Artificial Sequence
  Description of Artificial Sequence: Synthetic oligonucleotide
aacucuucccaccacgagugu

SEQ ID NO: 26259 - RNA, 21 nt, Artificial Sequence
  Description of Artificial Sequence: Synthetic oligonucleotide
aaacucuucccaccacgagug

SEQ ID NO: 26260 - RNA, 21 nt, Artificial Sequence
  Description of Artificial Sequence: Synthetic oligonucleotide
uaaacucuucccaccacgagu

SEQ ID NO: 26261 - RNA, 21 nt, Artificial Sequence
  Description of Artificial Sequence: Synthetic oligonucleotide
cuaaacucuucccaccacgag

SEQ ID NO: 26262 - RNA, 21 nt, Artificial Sequence
  Description of Artificial Sequence: Synthetic oligonucleotide
acuaaacucuucccaccacga

SEQ ID NO: 26263 - RNA, 21 nt, Artificial Sequence
  Description of Artificial Sequence: Synthetic oligonucleotide
cacuaaacucuucccaccacg

SEQ ID NO: 26264 - RNA, 21 nt, Artificial Sequence
  Description of Artificial Sequence: Synthetic oligonucleotide
acacuaaacucuucccaccac

SEQ ID NO: 26265 - RNA, 21 nt, Artificial Sequence
  Description of Artificial Sequence: Synthetic oligonucleotide
cacacuaaacucuucccacca

SEQ ID NO: 26266 - RNA, 21 nt, Artificial Sequence
  Description of Artificial Sequence: Synthetic oligonucleotide
ucacacuaaacucuucccacc

SEQ ID NO: 26267 - RNA, 21 nt, Artificial Sequence
  Description of Artificial Sequence: Synthetic oligonucleotide
uucacacuaaacucuucccac

SEQ ID NO: 26268 - RNA, 21 nt, Artificial Sequence
  Description of Artificial Sequence: Synthetic oligonucleotide
uuucacacuaaacucuuccca

SEQ ID NO: 26269 - RNA, 21 nt, Artificial Sequence
  Description of Artificial Sequence: Synthetic oligonucleotide
guuucacacuaaacucuuccc

SEQ ID NO: 26270 - RNA, 21 nt, Artificial Sequence
  Description of Artificial Sequence: Synthetic oligonucleotide
aguuucacacuaaacucuucc

SEQ ID NO: 26271 - RNA, 21 nt, Artificial Sequence
  Description of Artificial Sequence: Synthetic oligonucleotide
caguuucacacuaaacucuuc

SEQ ID NO: 26272 - RNA, 21 nt, Artificial Sequence
  Description of Artificial Sequence: Synthetic oligonucleotide
ccaguuucacacuaaacucuu

SEQ ID NO: 26273 - RNA, 21 nt, Artificial Sequence
  Description of Artificial Sequence: Synthetic oligonucleotide
cccaguuucacacuaaacucu

SEQ ID NO: 26274 - RNA, 21 nt, Artificial Sequence
  Description of Artificial Sequence: Synthetic oligonucleotide
ccccaguuucacacuaaacuc

SEQ ID NO: 26275 - RNA, 21 nt, Artificial Sequence
  Description of Artificial Sequence: Synthetic oligonucleotide
accccaguuucacacuaaacu

SEQ ID NO: 26276 - RNA, 21 nt, Artificial Sequence
  Description of Artificial Sequence: Synthetic oligonucleotide
caccccaguuucacacuaaac

SEQ ID NO: 26277 - RNA, 21 nt, Artificial Sequence
  Description of Artificial Sequence: Synthetic oligonucleotide
ccaccccaguuucacacuaaa

SEQ ID NO: 26278 - RNA, 21 nt, Artificial Sequence
  Description of Artificial Sequence: Synthetic oligonucleotide
uccaccccaguuucacacuaa

SEQ ID NO: 26279 - RNA, 21 nt, Artificial Sequence
  Description of Artificial Sequence: Synthetic oligonucleotide
uuccaccccaguuucacacua

SEQ ID NO: 26280 - RNA, 21 nt, Artificial Sequence
  Description of Artificial Sequence: Synthetic oligonucleotide
auuccaccccaguuucacacu

SEQ ID NO: 26281 - RNA, 21 nt, Artificial Sequence
  Description of Artificial Sequence: Synthetic oligonucleotide
aauuccaccccaguuucacac

SEQ ID NO: 26282 - RNA, 21 nt, Artificial Sequence
  Description of Artificial Sequence: Synthetic oligonucleotide
caauuccaccccaguuucaca

SEQ ID NO: 26283 - RNA, 21 nt, Artificial Sequence
  Description of Artificial Sequence: Synthetic oligonucleotide
ccaauuccaccccaguuucac

SEQ ID NO: 26284 - RNA, 21 nt, Artificial Sequence
  Description of Artificial Sequence: Synthetic oligonucleotide
cccaauuccaccccaguuuca

SEQ ID NO: 26285 - RNA, 21 nt, Artificial Sequence
  Description of Artificial Sequence: Synthetic oligonucleotide
acccaauuccaccccaguuuc

SEQ ID NO: 26286 - RNA, 21 nt, Artificial Sequence
  Description of Artificial Sequence: Synthetic oligonucleotide
cacccaauuccaccccaguuu

SEQ ID NO: 26287 - RNA, 21 nt, Artificial Sequence
  Description of Artificial Sequence: Synthetic oligonucleotide
acacccaauuccaccccaguu

SEQ ID NO: 26288 - RNA, 21 nt, Artificial Sequence
  Description of Artificial Sequence: Synthetic oligonucleotide
gacacccaauuccaccccagu

SEQ ID NO: 26289 - RNA, 21 nt, Artificial Sequence
  Description of Artificial Sequence: Synthetic oligonucleotide
ggacacccaauuccaccccag

SEQ ID NO: 26290 - RNA, 21 nt, Artificial Sequence
  Description of Artificial Sequence: Synthetic oligonucleotide
uggacacccaauuccacccca

SEQ ID NO: 26291 - RNA, 21 nt, Artificial Sequence
  Description of Artificial Sequence: Synthetic oligonucleotide
guggacacccaauuccacccc

SEQ ID NO: 26292 - RNA, 21 nt, Artificial Sequence
  Description of Artificial Sequence: Synthetic oligonucleotide
cguggacacccaauuccaccc

SEQ ID NO: 26293 - RNA, 21 nt, Artificial Sequence
  Description of Artificial Sequence: Synthetic oligonucleotide
acguggacacccaauuccacc

SEQ ID NO: 26294 - RNA, 21 nt, Artificial Sequence
  Description of Artificial Sequence: Synthetic oligonucleotide
uacguggacacccaauuccac

SEQ ID NO: 26295 - RNA, 21 nt, Artificial Sequence
  Description of Artificial Sequence: Synthetic oligonucleotide
auacguggacacccaauucca

SEQ ID NO: 26296 - RNA, 21 nt, Artificial Sequence
  Description of Artificial Sequence: Synthetic oligonucleotide
cauacguggacacccaauucc

SEQ ID NO: 26297 - RNA, 21 nt, Artificial Sequence
  Description of Artificial Sequence: Synthetic oligonucleotide
acauacguggacacccaauuc

SEQ ID NO: 26298 - RNA, 21 nt, Artificial Sequence
  Description of Artificial Sequence: Synthetic oligonucleotide
aacauacguggacacccaauu

SEQ ID NO: 26299 - RNA, 21 nt, Artificial Sequence
  Description of Artificial Sequence: Synthetic oligonucleotide
gaacauacguggacacccaau

SEQ ID NO: 26300 - RNA, 21 nt, Artificial Sequence
  Description of Artificial Sequence: Synthetic oligonucleotide
ggaacauacguggacacccaa

SEQ ID NO: 26301 - RNA, 21 nt, Artificial Sequence
  Description of Artificial Sequence: Synthetic oligonucleotide
gggaacauacguggacaccca

SEQ ID NO: 26302 - RNA, 21 nt, Artificial Sequence
  Description of Artificial Sequence: Synthetic oligonucleotide
agggaacauacguggacaccc

SEQ ID NO: 26303 - RNA, 21 nt, Artificial Sequence
  Description of Artificial Sequence: Synthetic oligonucleotide
aagggaacauacguggacacc

SEQ ID NO: 26304 - RNA, 21 nt, Artificial Sequence
  Description of Artificial Sequence: Synthetic oligonucleotide
aaagggaacauacguggacac

SEQ ID NO: 26305 - RNA, 21 nt, Artificial Sequence
  Description of Artificial Sequence: Synthetic oligonucleotide
aaaagggaacauacguggaca

SEQ ID NO: 26306 - RNA, 21 nt, Artificial Sequence
  Description of Artificial Sequence: Synthetic oligonucleotide
caaaagggaacauacguggac

SEQ ID NO: 26307 - RNA, 21 nt, Artificial Sequence
  Description of Artificial Sequence: Synthetic oligonucleotide
gcaaaagggaacauacgugga

SEQ ID NO: 26308 - RNA, 21 nt, Artificial Sequence
  Description of Artificial Sequence: Synthetic oligonucleotide
ggcaaaagggaacauacgugg

SEQ ID NO: 26309 - RNA, 21 nt, Artificial Sequence
  Description of Artificial Sequence: Synthetic oligonucleotide
aggcaaaagggaacauacgug

SEQ ID NO: 26310 - RNA, 21 nt, Artificial Sequence
  Description of Artificial Sequence: Synthetic oligonucleotide
aaggcaaaagggaacauacgu

SEQ ID NO: 26311 - RNA, 21 nt, Artificial Sequence
  Description of Artificial Sequence: Synthetic oligonucleotide
uaaggcaaaagggaacauacg

SEQ ID NO: 26312 - RNA, 21 nt, Artificial Sequence
  Description of Artificial Sequence: Synthetic oligonucleotide
guaaggcaaaagggaacauac

SEQ ID NO: 26313 - RNA, 21 nt, Artificial Sequence
  Description of Artificial Sequence: Synthetic oligonucleotide
aguaaggcaaaagggaacaua

SEQ ID NO: 26314 - RNA, 21 nt, Artificial Sequence
  Description of Artificial Sequence: Synthetic oligonucleotide
uaguaaggcaaaagggaacau

SEQ ID NO: 26315 - RNA, 21 nt, Artificial Sequence
  Description of Artificial Sequence: Synthetic oligonucleotide
auaguaaggcaaaagggaaca

SEQ ID NO: 26316 - RNA, 21 nt, Artificial Sequence
  Description of Artificial Sequence: Synthetic oligonucleotide
uauaguaaggcaaaagggaac

SEQ ID NO: 26317 - RNA, 21 nt, Artificial Sequence
  Description of Artificial Sequence: Synthetic oligonucleotide
auauaguaaggcaaaagggaa

SEQ ID NO: 26318 - RNA, 21 nt, Artificial Sequence
  Description of Artificial Sequence: Synthetic oligonucleotide
cauauaguaaggcaaaaggga

SEQ ID NO: 26319 - RNA, 21 nt, Artificial Sequence
  Description of Artificial Sequence: Synthetic oligonucleotide
acauauaguaaggcaaaaggg

SEQ ID NO: 26320 - RNA, 21 nt, Artificial Sequence
  Description of Artificial Sequence: Synthetic oligonucleotide
aacauauaguaaggcaaaagg

SEQ ID NO: 26321 - RNA, 21 nt, Artificial Sequence
  Description of Artificial Sequence: Synthetic oligonucleotide
gaacauauaguaaggcaaaag

SEQ ID NO: 26322 - RNA, 21 nt, Artificial Sequence
  Description of Artificial Sequence: Synthetic oligonucleotide
agaacauauaguaaggcaaaa

SEQ ID NO: 26323 - RNA, 21 nt, Artificial Sequence
  Description of Artificial Sequence: Synthetic oligonucleotide
cagaacauauaguaaggcaaa

SEQ ID NO: 26324 - RNA, 21 nt, Artificial Sequence
  Description of Artificial Sequence: Synthetic oligonucleotide
acagaacauauaguaaggcaa

SEQ ID NO: 26325 - RNA, 21 nt, Artificial Sequence
  Description of Artificial Sequence: Synthetic oligonucleotide
gacagaacauauaguaaggca

SEQ ID NO: 26326 - RNA, 21 nt, Artificial Sequence
  Description of Artificial Sequence: Synthetic oligonucleotide
ugacagaacauauaguaaggc

SEQ ID NO: 26327 - RNA, 21 nt, Artificial Sequence
  Description of Artificial Sequence: Synthetic oligonucleotide
cugacagaacauauaguaagg

SEQ ID NO: 26328 - RNA, 21 nt, Artificial Sequence
  Description of Artificial Sequence: Synthetic oligonucleotide
acugacagaacauauaguaag

SEQ ID NO: 26329 - RNA, 21 nt, Artificial Sequence
  Description of Artificial Sequence: Synthetic oligonucleotide
aacugacagaacauauaguaa

SEQ ID NO: 26330 - RNA, 21 nt, Artificial Sequence
  Description of Artificial Sequence: Synthetic oligonucleotide
aaacugacagaacauauagua

SEQ ID NO: 26331 - RNA, 21 nt, Artificial Sequence
  Description of Artificial Sequence: Synthetic oligonucleotide
gaaacugacagaacauauagu

SEQ ID NO: 26332 - RNA, 21 nt, Artificial Sequence
  Description of Artificial Sequence: Synthetic oligonucleotide
agaaacugacagaacauauag

SEQ ID NO: 26333 - RNA, 21 nt, Artificial Sequence
  Description of Artificial Sequence: Synthetic oligonucleotide
aagaaacugacagaacauaua

SEQ ID NO: 26334 - RNA, 21 nt, Artificial Sequence
  Description of Artificial Sequence: Synthetic oligonucleotide
aaagaaacugacagaacauau

SEQ ID NO: 26335 - RNA, 21 nt, Artificial Sequence
  Description of Artificial Sequence: Synthetic oligonucleotide
gaaagaaacugacagaacaua

SEQ ID NO: 26336 - RNA, 21 nt, Artificial Sequence
  Description of Artificial Sequence: Synthetic oligonucleotide
ugaaagaaacugacagaacau

SEQ ID NO: 26337 - RNA, 21 nt, Artificial Sequence
  Description of Artificial Sequence: Synthetic oligonucleotide
cugaaagaaacugacagaaca

SEQ ID NO: 26338 - RNA, 21 nt, Artificial Sequence
  Description of Artificial Sequence: Synthetic oligonucleotide
ccugaaagaaacugacagaac

SEQ ID NO: 26339 - RNA, 21 nt, Artificial Sequence
  Description of Artificial Sequence: Synthetic oligonucleotide
uccugaaagaaacugacagaa

SEQ ID NO: 26340 - RNA, 21 nt, Artificial Sequence
  Description of Artificial Sequence: Synthetic oligonucleotide
uuccugaaagaaacugacaga

SEQ ID NO: 26341 - RNA, 21 nt, Artificial Sequence
  Description of Artificial Sequence: Synthetic oligonucleotide
uuuccugaaagaaacugacag

SEQ ID NO: 26342 - RNA, 21 nt, Artificial Sequence
  Description of Artificial Sequence: Synthetic oligonucleotide
uuuuccugaaagaaacugaca

SEQ ID NO: 26343 - RNA, 21 nt, Artificial Sequence
  Description of Artificial Sequence: Synthetic oligonucleotide
auuuuccugaaagaaacugac

SEQ ID NO: 26344 - RNA, 21 nt, Artificial Sequence
  Description of Artificial Sequence: Synthetic oligonucleotide
gauuuuccugaaagaaacuga

SEQ ID NO: 26345 - RNA, 21 nt, Artificial Sequence
  Description of Artificial Sequence: Synthetic oligonucleotide
agauuuuccugaaagaaacug

SEQ ID NO: 26346 - RNA, 21 nt, Artificial Sequence
  Description of Artificial Sequence: Synthetic oligonucleotide
aagauuuuccugaaagaaacu

SEQ ID NO: 26347 - RNA, 21 nt, Artificial Sequence
  Description of Artificial Sequence: Synthetic oligonucleotide
gaagauuuuccugaaagaaac

SEQ ID NO: 26348 - RNA, 21 nt, Artificial Sequence
  Description of Artificial Sequence: Synthetic oligonucleotide
ugaagauuuuccugaaagaaa

SEQ ID NO: 26349 - RNA, 21 nt, Artificial Sequence
  Description of Artificial Sequence: Synthetic oligonucleotide
augaagauuuuccugaaagaa

SEQ ID NO: 26350 - RNA, 21 nt, Artificial Sequence
  Description of Artificial Sequence: Synthetic oligonucleotide
gaugaagauuuuccugaaaga

SEQ ID NO: 26351 - RNA, 21 nt, Artificial Sequence
  Description of Artificial Sequence: Synthetic oligonucleotide
agaugaagauuuuccugaaag

SEQ ID NO: 26352 - RNA, 21 nt, Artificial Sequence
  Description of Artificial Sequence: Synthetic oligonucleotide
aagaugaagauuuuccugaaa

SEQ ID NO: 26353 - RNA, 21 nt, Artificial Sequence
  Description of Artificial Sequence: Synthetic oligonucleotide
uaagaugaagauuuuccugaa

SEQ ID NO: 26354 - RNA, 21 nt, Artificial Sequence
  Description of Artificial Sequence: Synthetic oligonucleotide
guaagaugaagauuuuccuga

SEQ ID NO: 26355 - RNA, 21 nt, Artificial Sequence
  Description of Artificial Sequence: Synthetic oligonucleotide
uguaagaugaagauuuuccug

SEQ ID NO: 26356 - RNA, 21 nt, Artificial Sequence
  Description of Artificial Sequence: Synthetic oligonucleotide
uuguaagaugaagauuuuccu

SEQ ID NO: 26357 - RNA, 21 nt, Artificial Sequence
  Description of Artificial Sequence: Synthetic oligonucleotide
guuguaagaugaagauuuucc

SEQ ID NO: 26358 - RNA, 21 nt, Artificial Sequence
  Description of Artificial Sequence: Synthetic oligonucleotide
aguuguaagaugaagauuuuc

SEQ ID NO: 26359 - RNA, 21 nt, Artificial Sequence
  Description of Artificial Sequence: Synthetic oligonucleotide
aaguuguaagaugaagauuuu

SEQ ID NO: 26360 - RNA, 21 nt, Artificial Sequence
  Description of Artificial Sequence: Synthetic oligonucleotide
caaguuguaagaugaagauuu

SEQ ID NO: 26361 - RNA, 21 nt, Artificial Sequence
  Description of Artificial Sequence: Synthetic oligonucleotide
acaaguuguaagaugaagauu

SEQ ID NO: 26362 - RNA, 21 nt, Artificial Sequence
  Description of Artificial Sequence: Synthetic oligonucleotide
uacaaguuguaagaugaagau

SEQ ID NO: 26363 - RNA, 21 nt, Artificial Sequence
  Description of Artificial Sequence: Synthetic oligonucleotide
cuacaaguuguaagaugaaga

SEQ ID NO: 26364 - RNA, 21 nt, Artificial Sequence
  Description of Artificial Sequence: Synthetic oligonucleotide
ccuacaaguuguaagaugaag

SEQ ID NO: 26365 - RNA, 21 nt, Artificial Sequence
  Description of Artificial Sequence: Synthetic oligonucleotide
cccuacaaguuguaagaugaa

SEQ ID NO: 26366 - RNA, 21 nt, Artificial Sequence
  Description of Artificial Sequence: Synthetic oligonucleotide
gcccuacaaguuguaagauga

SEQ ID NO: 26367 - RNA, 21 nt, Artificial Sequence
  Description of Artificial Sequence: Synthetic oligonucleotide
agcccuacaaguuguaagaug

SEQ ID NO: 26368 - RNA, 21 nt, Artificial Sequence
  Description of Artificial Sequence: Synthetic oligonucleotide
cagcccuacaaguuguaagau

SEQ ID NO: 26369 - RNA, 21 nt, Artificial Sequence
  Description of Artificial Sequence: Synthetic oligonucleotide
ccagcccuacaaguuguaaga

SEQ ID NO: 26370 - RNA, 21 nt, Artificial Sequence
  Description of Artificial Sequence: Synthetic oligonucleotide
accagcccuacaaguuguaag

SEQ ID NO: 26371 - RNA, 21 nt, Artificial Sequence
  Description of Artificial Sequence: Synthetic oligonucleotide
caccagcccuacaaguuguaa

SEQ ID NO: 26372 - RNA, 21 nt, Artificial Sequence
  Description of Artificial Sequence: Synthetic oligonucleotide
acaccagcccuacaaguugua

SEQ ID NO: 26373 - RNA, 21 nt, Artificial Sequence
  Description of Artificial Sequence: Synthetic oligonucleotide
aacaccagcccuacaaguugu

SEQ ID NO: 26374 - RNA, 21 nt, Artificial Sequence
  Description of Artificial Sequence: Synthetic oligonucleotide
uaacaccagcccuacaaguug

SEQ ID NO: 26375 - RNA, 21 nt, Artificial Sequence
  Description of Artificial Sequence: Synthetic oligonucleotide
uuaacaccagcccuacaaguu

SEQ ID NO: 26376 - RNA, 21 nt, Artificial Sequence
  Description of Artificial Sequence: Synthetic oligonucleotide
guuaacaccagcccuacaagu

SEQ ID NO: 26377 - RNA, 21 nt, Artificial Sequence
  Description of Artificial Sequence: Synthetic oligonucleotide
aguuaacaccagcccuacaag

SEQ ID NO: 26378 - RNA, 21 nt, Artificial Sequence
  Description of Artificial Sequence: Synthetic oligonucleotide
aaguuaacaccagcccuacaa

SEQ ID NO: 26379 - RNA, 21 nt, Artificial Sequence
  Description of Artificial Sequence: Synthetic oligonucleotide
uaaguuaacaccagcccuaca

SEQ ID NO: 26380 - RNA, 21 nt, Artificial Sequence
  Description of Artificial Sequence: Synthetic oligonucleotide
guaaguuaacaccagcccuac

SEQ ID NO: 26381 - RNA, 21 nt, Artificial Sequence
  Description of Artificial Sequence: Synthetic oligonucleotide
cguaaguuaacaccagcccua

SEQ ID NO: 26382 - RNA, 21 nt, Artificial Sequence
  Description of Artificial Sequence: Synthetic oligonucleotide
ucguaaguuaacaccagcccu

SEQ ID NO: 26383 - RNA, 21 nt, Artificial Sequence
  Description of Artificial Sequence: Synthetic oligonucleotide
gucguaaguuaacaccagccc

SEQ ID NO: 26384 - RNA, 21 nt, Artificial Sequence
  Description of Artificial Sequence: Synthetic oligonucleotide
agucguaaguuaacaccagcc

SEQ ID NO: 26385 - RNA, 21 nt, Artificial Sequence
  Description of Artificial Sequence: Synthetic oligonucleotide
aagucguaaguuaacaccagc

SEQ ID NO: 26386 - RNA, 21 nt, Artificial Sequence
  Description of Artificial Sequence: Synthetic oligonucleotide
gaagucguaaguuaacaccag

SEQ ID NO: 26387 - RNA, 21 nt, Artificial Sequence
  Description of Artificial Sequence: Synthetic oligonucleotide
ugaagucguaaguuaacacca

SEQ ID NO: 26388 - RNA, 21 nt, Artificial Sequence
  Description of Artificial Sequence: Synthetic oligonucleotide
gugaagucguaaguuaacacc

SEQ ID NO: 26389 - RNA, 21 nt, Artificial Sequence
  Description of Artificial Sequence: Synthetic oligonucleotide
agugaagucguaaguuaacac

SEQ ID NO: 26390 - RNA, 21 nt, Artificial Sequence
  Description of Artificial Sequence: Synthetic oligonucleotide
uagugaagucguaaguuaaca

SEQ ID NO: 26391 - RNA, 21 nt, Artificial Sequence
  Description of Artificial Sequence: Synthetic oligonucleotide
uuagugaagucguaaguuaac

SEQ ID NO: 26392 - RNA, 21 nt, Artificial Sequence
  Description of Artificial Sequence: Synthetic oligonucleotide
guuagugaagucguaaguuaa

SEQ ID NO: 26393 - RNA, 21 nt, Artificial Sequence
  Description of Artificial Sequence: Synthetic oligonucleotide
aguuagugaagucguaaguua

SEQ ID NO: 26394 - RNA, 21 nt, Artificial Sequence
  Description of Artificial Sequence: Synthetic oligonucleotide
caguuagugaagucguaaguu

SEQ ID NO: 26395 - RNA, 21 nt, Artificial Sequence
  Description of Artificial Sequence: Synthetic oligonucleotide
acaguuagugaagucguaagu

SEQ ID NO: 26396 - RNA, 21 nt, Artificial Sequence
  Description of Artificial Sequence: Synthetic oligonucleotide
cacaguuagugaagucguaag

SEQ ID NO: 26397 - RNA, 21 nt, Artificial Sequence
  Description of Artificial Sequence: Synthetic oligonucleotide
ucacaguuagugaagucguaa

SEQ ID NO: 26398 - RNA, 21 nt, Artificial Sequence
  Description of Artificial Sequence: Synthetic oligonucleotide
gucacaguuagugaagucgua

SEQ ID NO: 26399 - RNA, 21 nt, Artificial Sequence
  Description of Artificial Sequence: Synthetic oligonucleotide
agucacaguuagugaagucgu

SEQ ID NO: 26400 - RNA, 21 nt, Artificial Sequence
  Description of Artificial Sequence: Synthetic oligonucleotide
aagucacaguuagugaagucg

SEQ ID NO: 26401 - RNA, 21 nt, Artificial Sequence
  Description of Artificial Sequence: Synthetic oligonucleotide
aaagucacaguuagugaaguc

SEQ ID NO: 26402 - RNA, 21 nt, Artificial Sequence
  Description of Artificial Sequence: Synthetic oligonucleotide
caaagucacaguuagugaagu

SEQ ID NO: 26403 - RNA, 21 nt, Artificial Sequence
  Description of Artificial Sequence: Synthetic oligonucleotide
ucaaagucacaguuagugaag

SEQ ID NO: 26404 - RNA, 21 nt, Artificial Sequence
  Description of Artificial Sequence: Synthetic oligonucleotide
cucaaagucacaguuagugaa

SEQ ID NO: 26405 - RNA, 21 nt, Artificial Sequence
  Description of Artificial Sequence: Synthetic oligonucleotide
ucucaaagucacaguuaguga

SEQ ID NO: 26406 - RNA, 21 nt, Artificial Sequence
  Description of Artificial Sequence: Synthetic oligonucleotide
uucucaaagucacaguuagug

SEQ ID NO: 26407 - RNA, 21 nt, Artificial Sequence
  Description of Artificial Sequence: Synthetic oligonucleotide
cuucucaaagucacaguuagu

SEQ ID NO: 26408 - RNA, 21 nt, Artificial Sequence
  Description of Artificial Sequence: Synthetic oligonucleotide
ucuucucaaagucacaguuag

SEQ ID NO: 26409 - RNA, 21 nt, Artificial Sequence
  Description of Artificial Sequence: Synthetic oligonucleotide
aucuucucaaagucacaguua

SEQ ID NO: 26410 - RNA, 21 nt, Artificial Sequence
  Description of Artificial Sequence: Synthetic oligonucleotide
aaucuucucaaagucacaguu

SEQ ID NO: 26411 - RNA, 21 nt, Artificial Sequence
  Description of Artificial Sequence: Synthetic oligonucleotide
uaaucuucucaaagucacagu

SEQ ID NO: 26412 - RNA, 21 nt, Artificial Sequence
  Description of Artificial Sequence: Synthetic oligonucleotide
uuaaucuucucaaagucacag

SEQ ID NO: 26413 - RNA, 21 nt, Artificial Sequence
  Description of Artificial Sequence: Synthetic oligonucleotide
uuuaaucuucucaaagucaca

SEQ ID NO: 26414 - RNA, 21 nt, Artificial Sequence
  Description of Artificial Sequence: Synthetic oligonucleotide
cuuuaaucuucucaaagucac

SEQ ID NO: 26415 - RNA, 21 nt, Artificial Sequence
  Description of Artificial Sequence: Synthetic oligonucleotide
gcuuuaaucuucucaaaguca

SEQ ID NO: 26416 - RNA, 21 nt, Artificial Sequence
  Description of Artificial Sequence: Synthetic oligonucleotide
ugcuuuaaucuucucaaaguc

SEQ ID NO: 26417 - RNA, 21 nt, Artificial Sequence
  Description of Artificial Sequence: Synthetic oligonucleotide
cugcuuuaaucuucucaaagu

SEQ ID NO: 26418 - RNA, 21 nt, Artificial Sequence
  Description of Artificial Sequence: Synthetic oligonucleotide
gcugcuuuaaucuucucaaag

SEQ ID NO: 26419 - RNA, 21 nt, Artificial Sequence
  Description of Artificial Sequence: Synthetic oligonucleotide
ggcugcuuuaaucuucucaaa

SEQ ID NO: 26420 - RNA, 21 nt, Artificial Sequence
  Description of Artificial Sequence: Synthetic oligonucleotide
aggcugcuuuaaucuucucaa

SEQ ID NO: 26421 - RNA, 21 nt, Artificial Sequence
  Description of Artificial Sequence: Synthetic oligonucleotide
uaggcugcuuuaaucuucuca

SEQ ID NO: 26422 - RNA, 21 nt, Artificial Sequence
  Description of Artificial Sequence: Synthetic oligonucleotide
auaggcugcuuuaaucuucuc

SEQ ID NO: 26423 - RNA, 21 nt, Artificial Sequence
  Description of Artificial Sequence: Synthetic oligonucleotide
gauaggcugcuuuaaucuucu

SEQ ID NO: 26424 - RNA, 21 nt, Artificial Sequence
  Description of Artificial Sequence: Synthetic oligonucleotide
agauaggcugcuuuaaucuuc

SEQ ID NO: 26425 - RNA, 21 nt, Artificial Sequence
  Description of Artificial Sequence: Synthetic oligonucleotide
gagauaggcugcuuuaaucuu

SEQ ID NO: 26426 - RNA, 21 nt, Artificial Sequence
  Description of Artificial Sequence: Synthetic oligonucleotide
ugagauaggcugcuuuaaucu

SEQ ID NO: 26427 - RNA, 21 nt, Artificial Sequence
  Description of Artificial Sequence: Synthetic oligonucleotide
cugagauaggcugcuuuaauc

SEQ ID NO: 26428 - RNA, 21 nt, Artificial Sequence
  Description of Artificial Sequence: Synthetic oligonucleotide
acugagauaggcugcuuuaau

SEQ ID NO: 26429 - RNA, 21 nt, Artificial Sequence
  Description of Artificial Sequence: Synthetic oligonucleotide
uacugagauaggcugcuuuaa

SEQ ID NO: 26430 - RNA, 21 nt, Artificial Sequence
  Description of Artificial Sequence: Synthetic oligonucleotide
guacugagauaggcugcuuua

SEQ ID NO: 26431 - RNA, 21 nt, Artificial Sequence
  Description of Artificial Sequence: Synthetic oligonucleotide
aguacugagauaggcugcuuu

SEQ ID NO: 26432 - RNA, 21 nt, Artificial Sequence
  Description of Artificial Sequence: Synthetic oligonucleotide
uaguacugagauaggcugcuu

SEQ ID NO: 26433 - RNA, 21 nt, Artificial Sequence
  Description of Artificial Sequence: Synthetic oligonucleotide
auaguacugagauaggcugcu

SEQ ID NO: 26434 - RNA, 21 nt, Artificial Sequence
  Description of Artificial Sequence: Synthetic oligonucleotide
aauaguacugagauaggcugc

SEQ ID NO: 26435 - RNA, 21 nt, Artificial Sequence
  Description of Artificial Sequence: Synthetic oligonucleotide
aaauaguacugagauaggcug

SEQ ID NO: 26436 - RNA, 21 nt, Artificial Sequence
  Description of Artificial Sequence: Synthetic oligonucleotide
gaaauaguacugagauaggcu

SEQ ID NO: 26437 - RNA, 21 nt, Artificial Sequence
  Description of Artificial Sequence: Synthetic oligonucleotide
agaaauaguacugagauaggc

SEQ ID NO: 26438 - RNA, 21 nt, Artificial Sequence
  Description of Artificial Sequence: Synthetic oligonucleotide
uagaaauaguacugagauagg

SEQ ID NO: 26439 - RNA, 21 nt, Artificial Sequence
  Description of Artificial Sequence: Synthetic oligonucleotide
uuagaaauaguacugagauag

SEQ ID NO: 26440 - RNA, 21 nt, Artificial Sequence
  Description of Artificial Sequence: Synthetic oligonucleotide
uuuagaaauaguacugagaua

SEQ ID NO: 26441 - RNA, 21 nt, Artificial Sequence
  Description of Artificial Sequence: Synthetic oligonucleotide
cuuuagaaauaguacugagau

SEQ ID NO: 26442 - RNA, 21 nt, Artificial Sequence
  Description of Artificial Sequence: Synthetic oligonucleotide
ucuuuagaaauaguacugaga

SEQ ID NO: 26443 - RNA, 21 nt, Artificial Sequence
  Description of Artificial Sequence: Synthetic oligonucleotide
gucuuuagaaauaguacugag

SEQ ID NO: 26444 - RNA, 21 nt, Artificial Sequence
  Description of Artificial Sequence: Synthetic oligonucleotide
ggucuuuagaaauaguacuga

SEQ ID NO: 26445 - RNA, 21 nt, Artificial Sequence
  Description of Artificial Sequence: Synthetic oligonucleotide
aggucuuuagaaauaguacug

SEQ ID NO: 26446 - RNA, 21 nt, Artificial Sequence
  Description of Artificial Sequence: Synthetic oligonucleotide
caggucuuuagaaauaguacu

SEQ ID NO: 26447 - RNA, 21 nt, Artificial Sequence
  Description of Artificial Sequence: Synthetic oligonucleotide
ucaggucuuuagaaauaguac

SEQ ID NO: 26448 - RNA, 21 nt, Artificial Sequence
  Description of Artificial Sequence: Synthetic oligonucleotide
aucaggucuuuagaaauagua

SEQ ID NO: 26449 - RNA, 21 nt, Artificial Sequence
  Description of Artificial Sequence: Synthetic oligonucleotide
aaucaggucuuuagaaauagu

SEQ ID NO: 26450 - RNA, 21 nt, Artificial Sequence
  Description of Artificial Sequence: Synthetic oligonucleotide
uaaucaggucuuuagaaauag

SEQ ID NO: 26451 - RNA, 21 nt, Artificial Sequence
  Description of Artificial Sequence: Synthetic oligonucleotide
guaaucaggucuuuagaaaua

SEQ ID NO: 26452 - RNA, 21 nt, Artificial Sequence
  Description of Artificial Sequence: Synthetic oligonucleotide
uguaaucaggucuuuagaaau

SEQ ID NO: 26453 - RNA, 21 nt, Artificial Sequence
  Description of Artificial Sequence: Synthetic oligonucleotide
auguaaucaggucuuuagaaa

SEQ ID NO: 26454 - RNA, 21 nt, Artificial Sequence
  Description of Artificial Sequence: Synthetic oligonucleotide
uauguaaucaggucuuuagaa

SEQ ID NO: 26455 - RNA, 21 nt, Artificial Sequence
  Description of Artificial Sequence: Synthetic oligonucleotide
auauguaaucaggucuuuaga

SEQ ID NO: 26456 - RNA, 21 nt, Artificial Sequence
  Description of Artificial Sequence: Synthetic oligonucleotide
uauauguaaucaggucuuuag

SEQ ID NO: 26457 - RNA, 21 nt, Artificial Sequence
  Description of Artificial Sequence: Synthetic oligonucleotide
auauauguaaucaggucuuua

SEQ ID NO: 26458 - RNA, 21 nt, Artificial Sequence
  Description of Artificial Sequence: Synthetic oligonucleotide
cauauauguaaucaggucuuu

SEQ ID NO: 26459 - RNA, 21 nt, Artificial Sequence
  Description of Artificial Sequence: Synthetic oligonucleotide
ucauauauguaaucaggucuu

SEQ ID NO: 26460 - RNA, 21 nt, Artificial Sequence
  Description of Artificial Sequence: Synthetic oligonucleotide
cucauauauguaaucaggucu

SEQ ID NO: 26461 - RNA, 21 nt, Artificial Sequence
  Description of Artificial Sequence: Synthetic oligonucleotide
acucauauauguaaucagguc

SEQ ID NO: 26462 - RNA, 21 nt, Artificial Sequence
  Description of Artificial Sequence: Synthetic oligonucleotide
cacucauauauguaaucaggu

SEQ ID NO: 26463 - RNA, 21 nt, Artificial Sequence
  Description of Artificial Sequence: Synthetic oligonucleotide
ccacucauauauguaaucagg

SEQ ID NO: 26464 - RNA, 21 nt, Artificial Sequence
  Description of Artificial Sequence: Synthetic oligonucleotide
cccacucauauauguaaucag

SEQ ID NO: 26465 - RNA, 21 nt, Artificial Sequence
  Description of Artificial Sequence: Synthetic oligonucleotide
ucccacucauauauguaauca

SEQ ID NO: 26466 - RNA, 21 nt, Artificial Sequence
  Description of Artificial Sequence: Synthetic oligonucleotide
gucccacucauauauguaauc

SEQ ID NO: 26467 - RNA, 21 nt, Artificial Sequence
  Description of Artificial Sequence: Synthetic oligonucleotide
ggucccacucauauauguaau

SEQ ID NO: 26468 - RNA, 21 nt, Artificial Sequence
  Description of Artificial Sequence: Synthetic oligonucleotide
uggucccacucauauauguaa

SEQ ID NO: 26469 - RNA, 21 nt, Artificial Sequence
  Description of Artificial Sequence: Synthetic oligonucleotide
uuggucccacucauauaugua

SEQ ID NO: 26470 - RNA, 21 nt, Artificial Sequence
  Description of Artificial Sequence: Synthetic oligonucleotide
uuuggucccacucauauaugu

SEQ ID NO: 26471 - RNA, 21 nt, Artificial Sequence
  Description of Artificial Sequence: Synthetic oligonucleotide
uuuuggucccacucauauaug

SEQ ID NO: 26472 - RNA, 21 nt, Artificial Sequence
  Description of Artificial Sequence: Synthetic oligonucleotide
cuuuuggucccacucauauau

SEQ ID NO: 26473 - RNA, 21 nt, Artificial Sequence
  Description of Artificial Sequence: Synthetic oligonucleotide
acuuuuggucccacucauaua

SEQ ID NO: 26474 - RNA, 21 nt, Artificial Sequence
  Description of Artificial Sequence: Synthetic oligonucleotide
uacuuuuggucccacucauau

SEQ ID NO: 26475 - RNA, 21 nt, Artificial Sequence
  Description of Artificial Sequence: Synthetic oligonucleotide
guacuuuuggucccacucaua

SEQ ID NO: 26476 - RNA, 21 nt, Artificial Sequence
  Description of Artificial Sequence: Synthetic oligonucleotide
gguacuuuuggucccacucau

SEQ ID NO: 26477 - RNA, 21 nt, Artificial Sequence
  Description of Artificial Sequence: Synthetic oligonucleotide
cgguacuuuuggucccacuca

SEQ ID NO: 26478 - RNA, 21 nt, Artificial Sequence
  Description of Artificial Sequence: Synthetic oligonucleotide
ucgguacuuuuggucccacuc

SEQ ID NO: 26479 - RNA, 21 nt, Artificial Sequence
  Description of Artificial Sequence: Synthetic oligonucleotide
cucgguacuuuuggucccacu

SEQ ID NO: 26480 - RNA, 21 nt, Artificial Sequence
  Description of Artificial Sequence: Synthetic oligonucleotide
acucgguacuuuuggucccac

SEQ ID NO: 26481 - RNA, 21 nt, Artificial Sequence
  Description of Artificial Sequence: Synthetic oligonucleotide
aacucgguacuuuugguccca

SEQ ID NO: 26482 - RNA, 21 nt, Artificial Sequence
  Description of Artificial Sequence: Synthetic oligonucleotide
gaacucgguacuuuugguccc

SEQ ID NO: 26483 - RNA, 21 nt, Artificial Sequence
  Description of Artificial Sequence: Synthetic oligonucleotide
ugaacucgguacuuuuggucc

SEQ ID NO: 26484 - RNA, 21 nt, Artificial Sequence
  Description of Artificial Sequence: Synthetic oligonucleotide
uugaacucgguacuuuugguc

SEQ ID NO: 26485 - RNA, 21 nt, Artificial Sequence
  Description of Artificial Sequence: Synthetic oligonucleotide
guugaacucgguacuuuuggu

SEQ ID NO: 26486 - RNA, 21 nt, Artificial Sequence
  Description of Artificial Sequence: Synthetic oligonucleotide
uguugaacucgguacuuuugg

SEQ ID NO: 26487 - RNA, 21 nt, Artificial Sequence
  Description of Artificial Sequence: Synthetic oligonucleotide
uuguugaacucgguacuuuug

SEQ ID NO: 26488 - RNA, 21 nt, Artificial Sequence
  Description of Artificial Sequence: Synthetic oligonucleotide
guuguugaacucgguacuuuu

SEQ ID NO: 26489 - RNA, 21 nt, Artificial Sequence
  Description of Artificial Sequence: Synthetic oligonucleotide
uguuguugaacucgguacuuu

SEQ ID NO: 26490 - RNA, 21 nt, Artificial Sequence
  Description of Artificial Sequence: Synthetic oligonucleotide
guguuguugaacucgguacuu

SEQ ID NO: 26491 - RNA, 21 nt, Artificial Sequence
  Description of Artificial Sequence: Synthetic oligonucleotide
gguguuguugaacucgguacu

SEQ ID NO: 26492 - RNA, 21 nt, Artificial Sequence
  Description of Artificial Sequence: Synthetic oligonucleotide
cgguguuguugaacucgguac

SEQ ID NO: 26493 - RNA, 21 nt, Artificial Sequence
  Description of Artificial Sequence: Synthetic oligonucleotide
acgguguuguugaacucggua

SEQ ID NO: 26494 - RNA, 21 nt, Artificial Sequence
  Description of Artificial Sequence: Synthetic oligonucleotide
gacgguguuguugaacucggu

SEQ ID NO: 26495 - RNA, 21 nt, Artificial Sequence
  Description of Artificial Sequence: Synthetic oligonucleotide
agacgguguuguugaacucgg

SEQ ID NO: 26496 - RNA, 21 nt, Artificial Sequence
  Description of Artificial Sequence: Synthetic oligonucleotide
gagacgguguuguugaacucg

SEQ ID NO: 26497 - RNA, 21 nt, Artificial Sequence
  Description of Artificial Sequence: Synthetic oligonucleotide
agagacgguguuguugaacuc

SEQ ID NO: 26498 - RNA, 21 nt, Artificial Sequence
  Description of Artificial Sequence: Synthetic oligonucleotide
aagagacgguguuguugaacu

SEQ ID NO: 26499 - RNA, 21 nt, Artificial Sequence
  Description of Artificial Sequence: Synthetic oligonucleotide
caagagacgguguuguugaac

SEQ ID NO: 26500 - RNA, 21 nt, Artificial Sequence
  Description of Artificial Sequence: Synthetic oligonucleotide
acaagagacgguguuguugaa

SEQ ID NO: 26501 - RNA, 21 nt, Artificial Sequence
  Description of Artificial Sequence: Synthetic oligonucleotide
uacaagagacgguguuguuga

SEQ ID NO: 26502 - RNA, 21 nt, Artificial Sequence
  Description of Artificial Sequence: Synthetic oligonucleotide
cuacaagagacgguguuguug

SEQ ID NO: 26503 - RNA, 21 nt, Artificial Sequence
  Description of Artificial Sequence: Synthetic oligonucleotide
gcuacaagagacgguguuguu

SEQ ID NO: 26504 - RNA, 21 nt, Artificial Sequence
  Description of Artificial Sequence: Synthetic oligonucleotide
ugcuacaagagacgguguugu

SEQ ID NO: 26505 - RNA, 21 nt, Artificial Sequence
  Description of Artificial Sequence: Synthetic oligonucleotide
uugcuacaagagacgguguug

SEQ ID NO: 26506 - RNA, 21 nt, Artificial Sequence
  Description of Artificial Sequence: Synthetic oligonucleotide
auugcuacaagagacgguguu

SEQ ID NO: 26507 - RNA, 21 nt, Artificial Sequence
  Description of Artificial Sequence: Synthetic oligonucleotide
gauugcuacaagagacggugu

SEQ ID NO: 26508 - RNA, 21 nt, Artificial Sequence
  Description of Artificial Sequence: Synthetic oligonucleotide
cgauugcuacaagagacggug

SEQ ID NO: 26509 - RNA, 21 nt, Artificial Sequence
  Description of Artificial Sequence: Synthetic oligonucleotide
ccgauugcuacaagagacggu

SEQ ID NO: 26510 - RNA, 21 nt, Artificial Sequence
  Description of Artificial Sequence: Synthetic oligonucleotide
gccgauugcuacaagagacgg

SEQ ID NO: 26511 - RNA, 21 nt, Artificial Sequence
  Description of Artificial Sequence: Synthetic oligonucleotide
ggccgauugcuacaagagacg

SEQ ID NO: 26512 - RNA, 21 nt, Artificial Sequence
  Description of Artificial Sequence: Synthetic oligonucleotide
uggccgauugcuacaagagac

SEQ ID NO: 26513 - RNA, 21 nt, Artificial Sequence
  Description of Artificial Sequence: Synthetic oligonucleotide
guggccgauugcuacaagaga

SEQ ID NO: 26514 - RNA, 21 nt, Artificial Sequence
  Description of Artificial Sequence: Synthetic oligonucleotide
uguggccgauugcuacaagag

SEQ ID NO: 26515 - RNA, 21 nt, Artificial Sequence
  Description of Artificial Sequence: Synthetic oligonucleotide
auguggccgauugcuacaaga

SEQ ID NO: 26516 - RNA, 21 nt, Artificial Sequence
  Description of Artificial Sequence: Synthetic oligonucleotide
aauguggccgauugcuacaag

SEQ ID NO: 26517 - RNA, 21 nt, Artificial Sequence
  Description of Artificial Sequence: Synthetic oligonucleotide
caauguggccgauugcuacaa

SEQ ID NO: 26518 - RNA, 21 nt, Artificial Sequence
  Description of Artificial Sequence: Synthetic oligonucleotide
gcaauguggccgauugcuaca

SEQ ID NO: 26519 - RNA, 21 nt, Artificial Sequence
  Description of Artificial Sequence: Synthetic oligonucleotide
ggcaauguggccgauugcuac

SEQ ID NO: 26520 - RNA, 21 nt, Artificial Sequence
  Description of Artificial Sequence: Synthetic oligonucleotide
aggcaauguggccgauugcua

SEQ ID NO: 26521 - RNA, 21 nt, Artificial Sequence
  Description of Artificial Sequence: Synthetic oligonucleotide
aaggcaauguggccgauugcu

SEQ ID NO: 26522 - RNA, 21 nt, Artificial Sequence
  Description of Artificial Sequence: Synthetic oligonucleotide
uaaggcaauguggccgauugc

SEQ ID NO: 26523 - RNA, 21 nt, Artificial Sequence
  Description of Artificial Sequence: Synthetic oligonucleotide
guaaggcaauguggccgauug

SEQ ID NO: 26524 - RNA, 21 nt, Artificial Sequence
  Description of Artificial Sequence: Synthetic oligonucleotide
aguaaggcaauguggccgauu

SEQ ID NO: 26525 - RNA, 21 nt, Artificial Sequence
  Description of Artificial Sequence: Synthetic oligonucleotide
caguaaggcaauguggccgau

SEQ ID NO: 26526 - RNA, 21 nt, Artificial Sequence
  Description of Artificial Sequence: Synthetic oligonucleotide
ucaguaaggcaauguggccga

SEQ ID NO: 26527 - RNA, 21 nt, Artificial Sequence
  Description of Artificial Sequence: Synthetic oligonucleotide
uucaguaaggcaauguggccg

SEQ ID NO: 26528 - RNA, 21 nt, Artificial Sequence
  Description of Artificial Sequence: Synthetic oligonucleotide
uuucaguaaggcaauguggcc

SEQ ID NO: 26529 - RNA, 21 nt, Artificial Sequence
  Description of Artificial Sequence: Synthetic oligonucleotide
auuucaguaaggcaauguggc

SEQ ID NO: 26530 - RNA, 21 nt, Artificial Sequence
  Description of Artificial Sequence: Synthetic oligonucleotide
gauuucaguaaggcaaugugg

SEQ ID NO: 26531 - RNA, 21 nt, Artificial Sequence
  Description of Artificial Sequence: Synthetic oligonucleotide
ggauuucaguaaggcaaugug

SEQ ID NO: 26532 - RNA, 21 nt, Artificial Sequence
  Description of Artificial Sequence: Synthetic oligonucleotide
uggauuucaguaaggcaaugu

SEQ ID NO: 26533 - RNA, 21 nt, Artificial Sequence
  Description of Artificial Sequence: Synthetic oligonucleotide
cuggauuucaguaaggcaaug

SEQ ID NO: 26534 - RNA, 21 nt, Artificial Sequence
  Description of Artificial Sequence: Synthetic oligonucleotide
ucuggauuucaguaaggcaau

SEQ ID NO: 26535 - RNA, 21 nt, Artificial Sequence
  Description of Artificial Sequence: Synthetic oligonucleotide
cucuggauuucaguaaggcaa

SEQ ID NO: 26536 - RNA, 21 nt, Artificial Sequence
  Description of Artificial Sequence: Synthetic oligonucleotide
gcucuggauuucaguaaggca

SEQ ID NO: 26537 - RNA, 21 nt, Artificial Sequence
  Description of Artificial Sequence: Synthetic oligonucleotide
ggcucuggauuucaguaaggc

SEQ ID NO: 26538 - RNA, 21 nt, Artificial Sequence
  Description of Artificial Sequence: Synthetic oligonucleotide
aggcucuggauuucaguaagg

SEQ ID NO: 26539 - RNA, 21 nt, Artificial Sequence
  Description of Artificial Sequence: Synthetic oligonucleotide
uaggcucuggauuucaguaag

SEQ ID NO: 26540 - RNA, 21 nt, Artificial Sequence
  Description of Artificial Sequence: Synthetic oligonucleotide
uuaggcucuggauuucaguaa

SEQ ID NO: 26541 - RNA, 21 nt, Artificial Sequence
  Description of Artificial Sequence: Synthetic oligonucleotide
guuaggcucuggauuucagua

SEQ ID NO: 26542 - RNA, 21 nt, Artificial Sequence
  Description of Artificial Sequence: Synthetic oligonucleotide
gguuaggcucuggauuucagu

SEQ ID NO: 26543 - RNA, 21 nt, Artificial Sequence
  Description of Artificial Sequence: Synthetic oligonucleotide
agguuaggcucuggauuucag

SEQ ID NO: 26544 - RNA, 21 nt, Artificial Sequence
  Description of Artificial Sequence: Synthetic oligonucleotide
aagguuaggcucuggauuuca

SEQ ID NO: 26545 - RNA, 21 nt, Artificial Sequence
  Description of Artificial Sequence: Synthetic oligonucleotide
gaagguuaggcucuggauuuc

SEQ ID NO: 26546 - RNA, 21 nt, Artificial Sequence
  Description of Artificial Sequence: Synthetic oligonucleotide
ugaagguuaggcucuggauuu

SEQ ID NO: 26547 - RNA, 21 nt, Artificial Sequence
  Description of Artificial Sequence: Synthetic oligonucleotide
uugaagguuaggcucuggauu

SEQ ID NO: 26548 - RNA, 21 nt, Artificial Sequence
  Description of Artificial Sequence: Synthetic oligonucleotide
auugaagguuaggcucuggau

SEQ ID NO: 26549 - RNA, 21 nt, Artificial Sequence
  Description of Artificial Sequence: Synthetic oligonucleotide
gauugaagguuaggcucugga

SEQ ID NO: 26550 - RNA, 21 nt, Artificial Sequence
  Description of Artificial Sequence: Synthetic oligonucleotide
ggauugaagguuaggcucugg

SEQ ID NO: 26551 - RNA, 21 nt, Artificial Sequence
  Description of Artificial Sequence: Synthetic oligonucleotide
gggauugaagguuaggcucug

SEQ ID NO: 26552 - RNA, 21 nt, Artificial Sequence
  Description of Artificial Sequence: Synthetic oligonucleotide
ugggauugaagguuaggcucu

SEQ ID NO: 26553 - RNA, 21 nt, Artificial Sequence
  Description of Artificial Sequence: Synthetic oligonucleotide
gugggauugaagguuaggcuc

SEQ ID NO: 26554 - RNA, 21 nt, Artificial Sequence
  Description of Artificial Sequence: Synthetic oligonucleotide
ggugggauugaagguuaggcu

SEQ ID NO: 26555 - RNA, 21 nt, Artificial Sequence
  Description of Artificial Sequence: Synthetic oligonucleotide
cggugggauugaagguuaggc

SEQ ID NO: 26556 - RNA, 21 nt, Artificial Sequence
  Description of Artificial Sequence: Synthetic oligonucleotide
gcggugggauugaagguuagg

SEQ ID NO: 26557 - RNA, 21 nt, Artificial Sequence
  Description of Artificial Sequence: Synthetic oligonucleotide
ggcggugggauugaagguuag

SEQ ID NO: 26558 - RNA, 21 nt, Artificial Sequence
  Description of Artificial Sequence: Synthetic oligonucleotide
cggcggugggauugaagguua

SEQ ID NO: 26559 - RNA, 21 nt, Artificial Sequence
  Description of Artificial Sequence: Synthetic oligonucleotide
ccggcggugggauugaagguu

SEQ ID NO: 26560 - RNA, 21 nt, Artificial Sequence
  Description of Artificial Sequence: Synthetic oligonucleotide
gccggcggugggauugaaggu

SEQ ID NO: 26561 - RNA, 21 nt, Artificial Sequence
  Description of Artificial Sequence: Synthetic oligonucleotide
agccggcggugggauugaagg

SEQ ID NO: 26562 - RNA, 21 nt, Artificial Sequence
  Description of Artificial Sequence: Synthetic oligonucleotide
cagccggcggugggauugaag

SEQ ID NO: 26563 - RNA, 21 nt, Artificial Sequence
  Description of Artificial Sequence: Synthetic oligonucleotide
gcagccggcggugggauugaa

SEQ ID NO: 26564 - RNA, 21 nt, Artificial Sequence
  Description of Artificial Sequence: Synthetic oligonucleotide
cgcagccggcggugggauuga

SEQ ID NO: 26565 - RNA, 21 nt, Artificial Sequence
  Description of Artificial Sequence: Synthetic oligonucleotide
gcgcagccggcggugggauug

SEQ ID NO: 26566 - RNA, 21 nt, Artificial Sequence
  Description of Artificial Sequence: Synthetic oligonucleotide
cgcgcagccggcggugggauu

SEQ ID NO: 26567 - RNA, 21 nt, Artificial Sequence
  Description of Artificial Sequence: Synthetic oligonucleotide
acgcgcagccggcggugggau

SEQ ID NO: 26568 - RNA, 21 nt, Artificial Sequence
  Description of Artificial Sequence: Synthetic oligonucleotide
gacgcgcagccggcgguggga

SEQ ID NO: 26569 - RNA, 21 nt, Artificial Sequence
  Description of Artificial Sequence: Synthetic oligonucleotide
cgacgcgcagccggcgguggg

SEQ ID NO: 26570 - RNA, 21 nt, Artificial Sequence
  Description of Artificial Sequence: Synthetic oligonucleotide
gcgacgcgcagccggcggugg

SEQ ID NO: 26571 - RNA, 21 nt, Artificial Sequence
  Description of Artificial Sequence: Synthetic oligonucleotide
agcgacgcgcagccggcggug

SEQ ID NO: 26572 - RNA, 21 nt, Artificial Sequence
  Description of Artificial Sequence: Synthetic oligonucleotide
gagcgacgcgcagccggcggu

SEQ ID NO: 26573 - RNA, 21 nt, Artificial Sequence
  Description of Artificial Sequence: Synthetic oligonucleotide
cgagcgacgcgcagccggcgg

SEQ ID NO: 26574 - RNA, 21 nt, Artificial Sequence
  Description of Artificial Sequence: Synthetic oligonucleotide
gcgagcgacgcgcagccggcg

SEQ ID NO: 26575 - RNA, 21 nt, Artificial Sequence
  Description of Artificial Sequence: Synthetic oligonucleotide
ggcgagcgacgcgcagccggc

SEQ ID NO: 26576 - RNA, 21 nt, Artificial Sequence
  Description of Artificial Sequence: Synthetic oligonucleotide
uggcgagcgacgcgcagccgg

SEQ ID NO: 26577 - RNA, 21 nt, Artificial Sequence
  Description of Artificial Sequence: Synthetic oligonucleotide
uuggcgagcgacgcgcagccg

SEQ ID NO: 26578 - RNA, 21 nt, Artificial Sequence
  Description of Artificial Sequence: Synthetic oligonucleotide
uuuggcgagcgacgcgcagcc

SEQ ID NO: 26579 - RNA, 21 nt, Artificial Sequence
  Description of Artificial Sequence: Synthetic oligonucleotide
cuuuggcgagcgacgcgcagc

SEQ ID NO: 26580 - RNA, 21 nt, Artificial Sequence
  Description of Artificial Sequence: Synthetic oligonucleotide
ucuuuggcgagcgacgcgcag

SEQ ID NO: 26581 - RNA, 21 nt, Artificial Sequence
  Description of Artificial Sequence: Synthetic oligonucleotide
uucuuuggcgagcgacgcgca

SEQ ID NO: 26582 - RNA, 21 nt, Artificial Sequence
  Description of Artificial Sequence: Synthetic oligonucleotide
uuucuuuggcgagcgacgcgc

SEQ ID NO: 26583 - RNA, 21 nt, Artificial Sequence
  Description of Artificial Sequence: Synthetic oligonucleotide
auuucuuuggcgagcgacgcg

SEQ ID NO: 26584 - RNA, 21 nt, Artificial Sequence
  Description of Artificial Sequence: Synthetic oligonucleotide
cauuucuuuggcgagcgacgc

SEQ ID NO: 26585 - RNA, 21 nt, Artificial Sequence
  Description of Artificial Sequence: Synthetic oligonucleotide
acauuucuuuggcgagcgacg

SEQ ID NO: 26586 - RNA, 21 nt, Artificial Sequence
  Description of Artificial Sequence: Synthetic oligonucleotide
aacauuucuuuggcgagcgac

SEQ ID NO: 26587 - RNA, 21 nt, Artificial Sequence
  Description of Artificial Sequence: Synthetic oligonucleotide
gaacauuucuuuggcgagcga

SEQ ID NO: 26588 - RNA, 21 nt, Artificial Sequence
  Description of Artificial Sequence: Synthetic oligonucleotide
cgaacauuucuuuggcgagcg

SEQ ID NO: 26589 - RNA, 21 nt, Artificial Sequence
  Description of Artificial Sequence: Synthetic oligonucleotide
gcgaacauuucuuuggcgagc

SEQ ID NO: 26590 - RNA, 21 nt, Artificial Sequence
  Description of Artificial Sequence: Synthetic oligonucleotide
ggcgaacauuucuuuggcgag

SEQ ID NO: 26591 - RNA, 21 nt, Artificial Sequence
  Description of Artificial Sequence: Synthetic oligonucleotide
uggcgaacauuucuuuggcga

SEQ ID NO: 26592 - RNA, 21 nt, Artificial Sequence
  Description of Artificial Sequence: Synthetic oligonucleotide
auggcgaacauuucuuuggcg

SEQ ID NO: 26593 - RNA, 21 nt, Artificial Sequence
  Description of Artificial Sequence: Synthetic oligonucleotide
cauggcgaacauuucuuuggc

SEQ ID NO: 26594 - RNA, 21 nt, Artificial Sequence
  Description of Artificial Sequence: Synthetic oligonucleotide
ucauggcgaacauuucuuugg

SEQ ID NO: 26595 - RNA, 21 nt, Artificial Sequence
  Description of Artificial Sequence: Synthetic oligonucleotide
uucauggcgaacauuucuuug

SEQ ID NO: 26596 - RNA, 21 nt, Artificial Sequence
  Description of Artificial Sequence: Synthetic oligonucleotide
uuucauggcgaacauuucuuu

SEQ ID NO: 26597 - RNA, 21 nt, Artificial Sequence
  Description of Artificial Sequence: Synthetic oligonucleotide
uuuucauggcgaacauuucuu

SEQ ID NO: 26598 - RNA, 21 nt, Artificial Sequence
  Description of Artificial Sequence: Synthetic oligonucleotide
guuuucauggcgaacauuucu

SEQ ID NO: 26599 - RNA, 21 nt, Artificial Sequence
  Description of Artificial Sequence: Synthetic oligonucleotide
aguuuucauggcgaacauuuc

SEQ ID NO: 26600 - RNA, 21 nt, Artificial Sequence
  Description of Artificial Sequence: Synthetic oligonucleotide
uaguuuucauggcgaacauuu

SEQ ID NO: 26601 - RNA, 21 nt, Artificial Sequence
  Description of Artificial Sequence: Synthetic oligonucleotide
uuaguuuucauggcgaacauu

SEQ ID NO: 26602 - RNA, 21 nt, Artificial Sequence
  Description of Artificial Sequence: Synthetic oligonucleotide
cuuaguuuucauggcgaacau

SEQ ID NO: 26603 - RNA, 21 nt, Artificial Sequence
  Description of Artificial Sequence: Synthetic oligonucleotide
ccuuaguuuucauggcgaaca

SEQ ID NO: 26604 - RNA, 21 nt, Artificial Sequence
  Description of Artificial Sequence: Synthetic oligonucleotide
gccuuaguuuucauggcgaac

SEQ ID NO: 26605 - RNA, 21 nt, Artificial Sequence
  Description of Artificial Sequence: Synthetic oligonucleotide
agccuuaguuuucauggcgaa

SEQ ID NO: 26606 - RNA, 21 nt, Artificial Sequence
  Description of Artificial Sequence: Synthetic oligonucleotide
cagccuuaguuuucauggcga

SEQ ID NO: 26607 - RNA, 21 nt, Artificial Sequence
  Description of Artificial Sequence: Synthetic oligonucleotide
gcagccuuaguuuucauggcg

SEQ ID NO: 26608 - RNA, 21 nt, Artificial Sequence
  Description of Artificial Sequence: Synthetic oligonucleotide
ggcagccuuaguuuucauggc

SEQ ID NO: 26609 - RNA, 21 nt, Artificial Sequence
  Description of Artificial Sequence: Synthetic oligonucleotide
aggcagccuuaguuuucaugg

SEQ ID NO: 26610 - RNA, 21 nt, Artificial Sequence
  Description of Artificial Sequence: Synthetic oligonucleotide
aaggcagccuuaguuuucaug

SEQ ID NO: 26611 - RNA, 21 nt, Artificial Sequence
  Description of Artificial Sequence: Synthetic oligonucleotide
uaaggcagccuuaguuuucau

SEQ ID NO: 26612 - RNA, 21 nt, Artificial Sequence
  Description of Artificial Sequence: Synthetic oligonucleotide
cuaaggcagccuuaguuuuca

SEQ ID NO: 26613 - RNA, 21 nt, Artificial Sequence
  Description of Artificial Sequence: Synthetic oligonucleotide
gcuaaggcagccuuaguuuuc

SEQ ID NO: 26614 - RNA, 21 nt, Artificial Sequence
  Description of Artificial Sequence: Synthetic oligonucleotide
agcuaaggcagccuuaguuuu

SEQ ID NO: 26615 - RNA, 21 nt, Artificial Sequence
  Description of Artificial Sequence: Synthetic oligonucleotide
uagcuaaggcagccuuaguuu

SEQ ID NO: 26616 - RNA, 21 nt, Artificial Sequence
  Description of Artificial Sequence: Synthetic oligonucleotide
auagcuaaggcagccuuaguu

SEQ ID NO: 26617 - RNA, 21 nt, Artificial Sequence
  Description of Artificial Sequence: Synthetic oligonucleotide
gauagcuaaggcagccuuagu

SEQ ID NO: 26618 - RNA, 21 nt, Artificial Sequence
  Description of Artificial Sequence: Synthetic oligonucleotide
agauagcuaaggcagccuuag

SEQ ID NO: 26619 - RNA, 21 nt, Artificial Sequence
  Description of Artificial Sequence: Synthetic oligonucleotide
cagauagcuaaggcagccuua

SEQ ID NO: 26620 - RNA, 21 nt, Artificial Sequence
  Description of Artificial Sequence: Synthetic oligonucleotide
ccagauagcuaaggcagccuu

SEQ ID NO: 26621 - RNA, 21 nt, Artificial Sequence
  Description of Artificial Sequence: Synthetic oligonucleotide
accagauagcuaaggcagccu

SEQ ID NO: 26622 - RNA, 21 nt, Artificial Sequence
  Description of Artificial Sequence: Synthetic oligonucleotide
caccagauagcuaaggcagcc

SEQ ID NO: 26623 - RNA, 21 nt, Artificial Sequence
  Description of Artificial Sequence: Synthetic oligonucleotide
gcaccagauagcuaaggcagc

SEQ ID NO: 26624 - RNA, 21 nt, Artificial Sequence
  Description of Artificial Sequence: Synthetic oligonucleotide
ggcaccagauagcuaaggcag

SEQ ID NO: 26625 - RNA, 21 nt, Artificial Sequence
  Description of Artificial Sequence: Synthetic oligonucleotide
gggcaccagauagcuaaggca

SEQ ID NO: 26626 - RNA, 21 nt, Artificial Sequence
  Description of Artificial Sequence: Synthetic oligonucleotide
ugggcaccagauagcuaaggc

SEQ ID NO: 26627 - RNA, 21 nt, Artificial Sequence
  Description of Artificial Sequence: Synthetic oligonucleotide
cugggcaccagauagcuaagg

SEQ ID NO: 26628 - RNA, 21 nt, Artificial Sequence
  Description of Artificial Sequence: Synthetic oligonucleotide
ccugggcaccagauagcuaag

SEQ ID NO: 26629 - RNA, 21 nt, Artificial Sequence
  Description of Artificial Sequence: Synthetic oligonucleotide
gccugggcaccagauagcuaa

SEQ ID NO: 26630 - RNA, 21 nt, Artificial Sequence
  Description of Artificial Sequence: Synthetic oligonucleotide
agccugggcaccagauagcua

SEQ ID NO: 26631 - RNA, 21 nt, Artificial Sequence
  Description of Artificial Sequence: Synthetic oligonucleotide
uagccugggcaccagauagcu

SEQ ID NO: 26632 - RNA, 21 nt, Artificial Sequence
  Description of Artificial Sequence: Synthetic oligonucleotide
auagccugggcaccagauagc

SEQ ID NO: 26633 - RNA, 21 nt, Artificial Sequence
  Description of Artificial Sequence: Synthetic oligonucleotide
aauagccugggcaccagauag

SEQ ID NO: 26634 - RNA, 21 nt, Artificial Sequence
  Description of Artificial Sequence: Synthetic oligonucleotide
gaauagccugggcaccagaua

SEQ ID NO: 26635 - RNA, 21 nt, Artificial Sequence
  Description of Artificial Sequence: Synthetic oligonucleotide
cgaauagccugggcaccagau

SEQ ID NO: 26636 - RNA, 21 nt, Artificial Sequence
  Description of Artificial Sequence: Synthetic oligonucleotide
ccgaauagccugggcaccaga

SEQ ID NO: 26637 - RNA, 21 nt, Artificial Sequence
  Description of Artificial Sequence: Synthetic oligonucleotide
uccgaauagccugggcaccag

SEQ ID NO: 26638 - RNA, 21 nt, Artificial Sequence
  Description of Artificial Sequence: Synthetic oligonucleotide
uuccgaauagccugggcacca

SEQ ID NO: 26639 - RNA, 21 nt, Artificial Sequence
  Description of Artificial Sequence: Synthetic oligonucleotide
uuuccgaauagccugggcacc

SEQ ID NO: 26640 - RNA, 21 nt, Artificial Sequence
  Description of Artificial Sequence: Synthetic oligonucleotide
guuuccgaauagccugggcac

SEQ ID NO: 26641 - RNA, 21 nt, Artificial Sequence
  Description of Artificial Sequence: Synthetic oligonucleotide
aguuuccgaauagccugggca

SEQ ID NO: 26642 - RNA, 21 nt, Artificial Sequence
  Description of Artificial Sequence: Synthetic oligonucleotide
gaguuuccgaauagccugggc

SEQ ID NO: 26643 - RNA, 21 nt, Artificial Sequence
  Description of Artificial Sequence: Synthetic oligonucleotide
ugaguuuccgaauagccuggg

SEQ ID NO: 26644 - RNA, 21 nt, Artificial Sequence
  Description of Artificial Sequence: Synthetic oligonucleotide
cugaguuuccgaauagccugg

SEQ ID NO: 26645 - RNA, 21 nt, Artificial Sequence
  Description of Artificial Sequence: Synthetic oligonucleotide
ucugaguuuccgaauagccug

SEQ ID NO: 26646 - RNA, 21 nt, Artificial Sequence
  Description of Artificial Sequence: Synthetic oligonucleotide
aucugaguuuccgaauagccu

SEQ ID NO: 26647 - RNA, 21 nt, Artificial Sequence
  Description of Artificial Sequence: Synthetic oligonucleotide
uaucugaguuuccgaauagcc

SEQ ID NO: 26648 - RNA, 21 nt, Artificial Sequence
  Description of Artificial Sequence: Synthetic oligonucleotide
uuaucugaguuuccgaauagc

SEQ ID NO: 26649 - RNA, 21 nt, Artificial Sequence
  Description of Artificial Sequence: Synthetic oligonucleotide
uuuaucugaguuuccgaauag

SEQ ID NO: 26650 - RNA, 21 nt, Artificial Sequence
  Description of Artificial Sequence: Synthetic oligonucleotide
auuuaucugaguuuccgaaua

SEQ ID NO: 26651 - RNA, 21 nt, Artificial Sequence
  Description of Artificial Sequence: Synthetic oligonucleotide
cauuuaucugaguuuccgaau

SEQ ID NO: 26652 - RNA, 21 nt, Artificial Sequence
  Description of Artificial Sequence: Synthetic oligonucleotide
gcauuuaucugaguuuccgaa

SEQ ID NO: 26653 - RNA, 21 nt, Artificial Sequence
  Description of Artificial Sequence: Synthetic oligonucleotide
agcauuuaucugaguuuccga

SEQ ID NO: 26654 - RNA, 21 nt, Artificial Sequence
  Description of Artificial Sequence: Synthetic oligonucleotide
uagcauuuaucugaguuuccg

SEQ ID NO: 26655 - RNA, 21 nt, Artificial Sequence
  Description of Artificial Sequence: Synthetic oligonucleotide
guagcauuuaucugaguuucc

SEQ ID NO: 26656 - RNA, 21 nt, Artificial Sequence
  Description of Artificial Sequence: Synthetic oligonucleotide
aguagcauuuaucugaguuuc

SEQ ID NO: 26657 - RNA, 21 nt, Artificial Sequence
  Description of Artificial Sequence: Synthetic oligonucleotide
gaguagcauuuaucugaguuu

SEQ ID NO: 26658 - RNA, 21 nt, Artificial Sequence
  Description of Artificial Sequence: Synthetic oligonucleotide
ugaguagcauuuaucugaguu

SEQ ID NO: 26659 - RNA, 21 nt, Artificial Sequence
  Description of Artificial Sequence: Synthetic oligonucleotide
cugaguagcauuuaucugagu

SEQ ID NO: 26660 - RNA, 21 nt, Artificial Sequence
  Description of Artificial Sequence: Synthetic oligonucleotide
ccugaguagcauuuaucugag

SEQ ID NO: 26661 - RNA, 21 nt, Artificial Sequence
  Description of Artificial Sequence: Synthetic oligonucleotide
gccugaguagcauuuaucuga

SEQ ID NO: 26662 - RNA, 21 nt, Artificial Sequence
  Description of Artificial Sequence: Synthetic oligonucleotide
ugccugaguagcauuuaucug

SEQ ID NO: 26663 - RNA, 21 nt, Artificial Sequence
  Description of Artificial Sequence: Synthetic oligonucleotide
uugccugaguagcauuuaucu

SEQ ID NO: 26664 - RNA, 21 nt, Artificial Sequence
  Description of Artificial Sequence: Synthetic oligonucleotide
auugccugaguagcauuuauc

SEQ ID NO: 26665 - RNA, 21 nt, Artificial Sequence
  Description of Artificial Sequence: Synthetic oligonucleotide
cauugccugaguagcauuuau

SEQ ID NO: 26666 - RNA, 21 nt, Artificial Sequence
  Description of Artificial Sequence: Synthetic oligonucleotide
ucauugccugaguagcauuua

SEQ ID NO: 26667 - RNA, 21 nt, Artificial Sequence
  Description of Artificial Sequence: Synthetic oligonucleotide
uucauugccugaguagcauuu

SEQ ID NO: 26668 - RNA, 21 nt, Artificial Sequence
  Description of Artificial Sequence: Synthetic oligonucleotide
cuucauugccugaguagcauu

SEQ ID NO: 26669 - RNA, 21 nt, Artificial Sequence
  Description of Artificial Sequence: Synthetic oligonucleotide
ucuucauugccugaguagcau

SEQ ID NO: 26670 - RNA, 21 nt, Artificial Sequence
  Description of Artificial Sequence: Synthetic oligonucleotide
uucuucauugccugaguagca

SEQ ID NO: 26671 - RNA, 21 nt, Artificial Sequence
  Description of Artificial Sequence: Synthetic oligonucleotide
cuucuucauugccugaguagc

SEQ ID NO: 26672 - RNA, 21 nt, Artificial Sequence
  Description of Artificial Sequence: Synthetic oligonucleotide
ucuucuucauugccugaguag

SEQ ID NO: 26673 - RNA, 21 nt, Artificial Sequence
  Description of Artificial Sequence: Synthetic oligonucleotide
cucuucuucauugccugagua

SEQ ID NO: 26674 - RNA, 21 nt, Artificial Sequence
  Description of Artificial Sequence: Synthetic oligonucleotide
ccucuucuucauugccugagu

SEQ ID NO: 26675 - RNA, 21 nt, Artificial Sequence
  Description of Artificial Sequence: Synthetic oligonucleotide
uccucuucuucauugccugag

SEQ ID NO: 26676 - RNA, 21 nt, Artificial Sequence
  Description of Artificial Sequence: Synthetic oligonucleotide
cuccucuucuucauugccuga

SEQ ID NO: 26677 - RNA, 21 nt, Artificial Sequence
  Description of Artificial Sequence: Synthetic oligonucleotide
ucuccucuucuucauugccug

SEQ ID NO: 26678 - RNA, 21 nt, Artificial Sequence
  Description of Artificial Sequence: Synthetic oligonucleotide
uucuccucuucuucauugccu

SEQ ID NO: 26679 - RNA, 21 nt, Artificial Sequence
  Description of Artificial Sequence: Synthetic oligonucleotide
uuucuccucuucuucauugcc

SEQ ID NO: 26680 - RNA, 21 nt, Artificial Sequence
  Description of Artificial Sequence: Synthetic oligonucleotide
uuuucuccucuucuucauugc

SEQ ID NO: 26681 - RNA, 21 nt, Artificial Sequence
  Description of Artificial Sequence: Synthetic oligonucleotide
uuuuucuccucuucuucauug

SEQ ID NO: 26682 - RNA, 21 nt, Artificial Sequence
  Description of Artificial Sequence: Synthetic oligonucleotide
cuuuuucuccucuucuucauu

SEQ ID NO: 26683 - RNA, 21 nt, Artificial Sequence
  Description of Artificial Sequence: Synthetic oligonucleotide
ccuuuuucuccucuucuucau

SEQ ID NO: 26684 - RNA, 21 nt, Artificial Sequence
  Description of Artificial Sequence: Synthetic oligonucleotide
uccuuuuucuccucuucuuca

SEQ ID NO: 26685 - RNA, 21 nt, Artificial Sequence
  Description of Artificial Sequence: Synthetic oligonucleotide
uuccuuuuucuccucuucuuc

SEQ ID NO: 26686 - RNA, 21 nt, Artificial Sequence
  Description of Artificial Sequence: Synthetic oligonucleotide
uuuccuuuuucuccucuucuu

SEQ ID NO: 26687 - RNA, 21 nt, Artificial Sequence
  Description of Artificial Sequence: Synthetic oligonucleotide
cuuuccuuuuucuccucuucu

SEQ ID NO: 26688 - RNA, 21 nt, Artificial Sequence
  Description of Artificial Sequence: Synthetic oligonucleotide
acuuuccuuuuucuccucuuc

SEQ ID NO: 26689 - RNA, 21 nt, Artificial Sequence
  Description of Artificial Sequence: Synthetic oligonucleotide
gacuuuccuuuuucuccucuu

SEQ ID NO: 26690 - RNA, 21 nt, Artificial Sequence
  Description of Artificial Sequence: Synthetic oligonucleotide
ugacuuuccuuuuucuccucu

SEQ ID NO: 26691 - RNA, 21 nt, Artificial Sequence
  Description of Artificial Sequence: Synthetic oligonucleotide
gugacuuuccuuuuucuccuc

SEQ ID NO: 26692 - RNA, 21 nt, Artificial Sequence
  Description of Artificial Sequence: Synthetic oligonucleotide
ugugacuuuccuuuuucuccu

SEQ ID NO: 26693 - RNA, 21 nt, Artificial Sequence
  Description of Artificial Sequence: Synthetic oligonucleotide
uugugacuuuccuuuuucucc

SEQ ID NO: 26694 - RNA, 21 nt, Artificial Sequence
  Description of Artificial Sequence: Synthetic oligonucleotide
guugugacuuuccuuuuucuc

SEQ ID NO: 26695 - RNA, 21 nt, Artificial Sequence
  Description of Artificial Sequence: Synthetic oligonucleotide
gguugugacuuuccuuuuucu

SEQ ID NO: 26696 - RNA, 21 nt, Artificial Sequence
  Description of Artificial Sequence: Synthetic oligonucleotide
ugguugugacuuuccuuuuuc

SEQ ID NO: 26697 - RNA, 21 nt, Artificial Sequence
  Description of Artificial Sequence: Synthetic oligonucleotide
uugguugugacuuuccuuuuu

SEQ ID NO: 26698 - RNA, 21 nt, Artificial Sequence
  Description of Artificial Sequence: Synthetic oligonucleotide
auugguugugacuuuccuuuu

SEQ ID NO: 26699 - RNA, 21 nt, Artificial Sequence
  Description of Artificial Sequence: Synthetic oligonucleotide
uauugguugugacuuuccuuu

SEQ ID NO: 26700 - RNA, 21 nt, Artificial Sequence
  Description of Artificial Sequence: Synthetic oligonucleotide
uuauugguugugacuuuccuu

SEQ ID NO: 26701 - RNA, 21 nt, Artificial Sequence
  Description of Artificial Sequence: Synthetic oligonucleotide
uuuauugguugugacuuuccu

SEQ ID NO: 26702 - RNA, 21 nt, Artificial Sequence
  Description of Artificial Sequence: Synthetic oligonucleotide
auuuauugguugugacuuucc

SEQ ID NO: 26703 - RNA, 21 nt, Artificial Sequence
  Description of Artificial Sequence: Synthetic oligonucleotide
cauuuauugguugugacuuuc

SEQ ID NO: 26704 - RNA, 21 nt, Artificial Sequence
  Description of Artificial Sequence: Synthetic oligonucleotide
acauuuauugguugugacuuu

SEQ ID NO: 26705 - RNA, 21 nt, Artificial Sequence
  Description of Artificial Sequence: Synthetic oligonucleotide
gacauuuauugguugugacuu

SEQ ID NO: 26706 - RNA, 21 nt, Artificial Sequence
  Description of Artificial Sequence: Synthetic oligonucleotide
agacauuuauugguugugacu

SEQ ID NO: 26707 - RNA, 21 nt, Artificial Sequence
  Description of Artificial Sequence: Synthetic oligonucleotide
cagacauuuauugguugugac

SEQ ID NO: 26708 - RNA, 21 nt, Artificial Sequence
  Description of Artificial Sequence: Synthetic oligonucleotide
ccagacauuuauugguuguga

SEQ ID NO: 26709 - RNA, 21 nt, Artificial Sequence
  Description of Artificial Sequence: Synthetic oligonucleotide
uccagacauuuauugguugug

SEQ ID NO: 26710 - RNA, 21 nt, Artificial Sequence
  Description of Artificial Sequence: Synthetic oligonucleotide
uuccagacauuuauugguugu

SEQ ID NO: 26711 - RNA, 21 nt, Artificial Sequence
  Description of Artificial Sequence: Synthetic oligonucleotide
guuccagacauuuauugguug

SEQ ID NO: 26712 - RNA, 21 nt, Artificial Sequence
  Description of Artificial Sequence: Synthetic oligonucleotide
uguuccagacauuuauugguu

SEQ ID NO: 26713 - RNA, 21 nt, Artificial Sequence
  Description of Artificial Sequence: Synthetic oligonucleotide
uuguuccagacauuuauuggu

SEQ ID NO: 26714 - RNA, 21 nt, Artificial Sequence
  Description of Artificial Sequence: Synthetic oligonucleotide
cuuguuccagacauuuauugg

SEQ ID NO: 26715 - RNA, 21 nt, Artificial Sequence
  Description of Artificial Sequence: Synthetic oligonucleotide
acuuguuccagacauuuauug

SEQ ID NO: 26716 - RNA, 21 nt, Artificial Sequence
  Description of Artificial Sequence: Synthetic oligonucleotide
cacuuguuccagacauuuauu

SEQ ID NO: 26717 - RNA, 21 nt, Artificial Sequence
  Description of Artificial Sequence: Synthetic oligonucleotide
acacuuguuccagacauuuau

SEQ ID NO: 26718 - RNA, 21 nt, Artificial Sequence
  Description of Artificial Sequence: Synthetic oligonucleotide
gacacuuguuccagacauuua

SEQ ID NO: 26719 - RNA, 21 nt, Artificial Sequence
  Description of Artificial Sequence: Synthetic oligonucleotide
ugacacuuguuccagacauuu

SEQ ID NO: 26720 - RNA, 21 nt, Artificial Sequence
  Description of Artificial Sequence: Synthetic oligonucleotide
gugacacuuguuccagacauu

SEQ ID NO: 26721 - RNA, 21 nt, Artificial Sequence
  Description of Artificial Sequence: Synthetic oligonucleotide
ugugacacuuguuccagacau

SEQ ID NO: 26722 - RNA, 21 nt, Artificial Sequence
  Description of Artificial Sequence: Synthetic oligonucleotide
uugugacacuuguuccagaca

SEQ ID NO: 26723 - RNA, 21 nt, Artificial Sequence
  Description of Artificial Sequence: Synthetic oligonucleotide
auugugacacuuguuccagac

SEQ ID NO: 26724 - RNA, 21 nt, Artificial Sequence
  Description of Artificial Sequence: Synthetic oligonucleotide
aauugugacacuuguuccaga

SEQ ID NO: 26725 - RNA, 21 nt, Artificial Sequence
  Description of Artificial Sequence: Synthetic oligonucleotide
uaauugugacacuuguuccag

SEQ ID NO: 26726 - RNA, 21 nt, Artificial Sequence
  Description of Artificial Sequence: Synthetic oligonucleotide
guaauugugacacuuguucca

SEQ ID NO: 26727 - RNA, 21 nt, Artificial Sequence
  Description of Artificial Sequence: Synthetic oligonucleotide
uguaauugugacacuuguucc

SEQ ID NO: 26728 - RNA, 21 nt, Artificial Sequence
  Description of Artificial Sequence: Synthetic oligonucleotide
uuguaauugugacacuuguuc

SEQ ID NO: 26729 - RNA, 21 nt, Artificial Sequence
  Description of Artificial Sequence: Synthetic oligonucleotide
cuuguaauugugacacuuguu

SEQ ID NO: 26730 - RNA, 21 nt, Artificial Sequence
  Description of Artificial Sequence: Synthetic oligonucleotide
ccuuguaauugugacacuugu

SEQ ID NO: 26731 - RNA, 21 nt, Artificial Sequence
  Description of Artificial Sequence: Synthetic oligonucleotide
uccuuguaauugugacacuug

SEQ ID NO: 26732 - RNA, 21 nt, Artificial Sequence
  Description of Artificial Sequence: Synthetic oligonucleotide
auccuuguaauugugacacuu

SEQ ID NO: 26733 - RNA, 21 nt, Artificial Sequence
  Description of Artificial Sequence: Synthetic oligonucleotide
aauccuuguaauugugacacu

SEQ ID NO: 26734 - RNA, 21 nt, Artificial Sequence
  Description of Artificial Sequence: Synthetic oligonucleotide
caauccuuguaauugugacac

SEQ ID NO: 26735 - RNA, 21 nt, Artificial Sequence
  Description of Artificial Sequence: Synthetic oligonucleotide
acaauccuuguaauugugaca

SEQ ID NO: 26736 - RNA, 21 nt, Artificial Sequence
  Description of Artificial Sequence: Synthetic oligonucleotide
cacaauccuuguaauugugac

SEQ ID NO: 26737 - RNA, 21 nt, Artificial Sequence
  Description of Artificial Sequence: Synthetic oligonucleotide
ccacaauccuuguaauuguga

SEQ ID NO: 26738 - RNA, 21 nt, Artificial Sequence
  Description of Artificial Sequence: Synthetic oligonucleotide
gccacaauccuuguaauugug

SEQ ID NO: 26739 - RNA, 21 nt, Artificial Sequence
  Description of Artificial Sequence: Synthetic oligonucleotide
cgccacaauccuuguaauugu

SEQ ID NO: 26740 - RNA, 21 nt, Artificial Sequence
  Description of Artificial Sequence: Synthetic oligonucleotide
acgccacaauccuuguaauug

SEQ ID NO: 26741 - RNA, 21 nt, Artificial Sequence
  Description of Artificial Sequence: Synthetic oligonucleotide
gacgccacaauccuuguaauu

SEQ ID NO: 26742 - RNA, 21 nt, Artificial Sequence
  Description of Artificial Sequence: Synthetic oligonucleotide
cgacgccacaauccuuguaau

SEQ ID NO: 26743 - RNA, 21 nt, Artificial Sequence
  Description of Artificial Sequence: Synthetic oligonucleotide
gcgacgccacaauccuuguaa

SEQ ID NO: 26744 - RNA, 21 nt, Artificial Sequence
  Description of Artificial Sequence: Synthetic oligonucleotide
agcgacgccacaauccuugua

SEQ ID NO: 26745 - RNA, 21 nt, Artificial Sequence
  Description of Artificial Sequence: Synthetic oligonucleotide
aagcgacgccacaauccuugu

SEQ ID NO: 26746 - RNA, 21 nt, Artificial Sequence
  Description of Artificial Sequence: Synthetic oligonucleotide
gaagcgacgccacaauccuug

SEQ ID NO: 26747 - RNA, 21 nt, Artificial Sequence
  Description of Artificial Sequence: Synthetic oligonucleotide
ugaagcgacgccacaauccuu

SEQ ID NO: 26748 - RNA, 21 nt, Artificial Sequence
  Description of Artificial Sequence: Synthetic oligonucleotide
uugaagcgacgccacaauccu

SEQ ID NO: 26749 - RNA, 21 nt, Artificial Sequence
  Description of Artificial Sequence: Synthetic oligonucleotide
auugaagcgacgccacaaucc

SEQ ID NO: 26750 - RNA, 21 nt, Artificial Sequence
  Description of Artificial Sequence: Synthetic oligonucleotide
gauugaagcgacgccacaauc

SEQ ID NO: 26751 - RNA, 21 nt, Artificial Sequence
  Description of Artificial Sequence: Synthetic oligonucleotide
cgauugaagcgacgccacaau

SEQ ID NO: 26752 - RNA, 21 nt, Artificial Sequence
  Description of Artificial Sequence: Synthetic oligonucleotide
ucgauugaagcgacgccacaa

SEQ ID NO: 26753 - RNA, 21 nt, Artificial Sequence
  Description of Artificial Sequence: Synthetic oligonucleotide
gucgauugaagcgacgccaca

SEQ ID NO: 26754 - RNA, 21 nt, Artificial Sequence
  Description of Artificial Sequence: Synthetic oligonucleotide
ggucgauugaagcgacgccac

SEQ ID NO: 26755 - RNA, 21 nt, Artificial Sequence
  Description of Artificial Sequence: Synthetic oligonucleotide
aggucgauugaagcgacgcca

SEQ ID NO: 26756 - RNA, 21 nt, Artificial Sequence
  Description of Artificial Sequence: Synthetic oligonucleotide
aaggucgauugaagcgacgcc

SEQ ID NO: 26757 - RNA, 21 nt, Artificial Sequence
  Description of Artificial Sequence: Synthetic oligonucleotide
aaaggucgauugaagcgacgc

SEQ ID NO: 26758 - RNA, 21 nt, Artificial Sequence
  Description of Artificial Sequence: Synthetic oligonucleotide
uaaaggucgauugaagcgacg

SEQ ID NO: 26759 - RNA, 21 nt, Artificial Sequence
  Description of Artificial Sequence: Synthetic oligonucleotide
guaaaggucgauugaagcgac

SEQ ID NO: 26760 - RNA, 21 nt, Artificial Sequence
  Description of Artificial Sequence: Synthetic oligonucleotide
aguaaaggucgauugaagcga

SEQ ID NO: 26761 - RNA, 21 nt, Artificial Sequence
  Description of Artificial Sequence: Synthetic oligonucleotide
caguaaaggucgauugaagcg

SEQ ID NO: 26762 - RNA, 21 nt, Artificial Sequence
  Description of Artificial Sequence: Synthetic oligonucleotide
ucaguaaaggucgauugaagc

SEQ ID NO: 26763 - RNA, 21 nt, Artificial Sequence
  Description of Artificial Sequence: Synthetic oligonucleotide
uucaguaaaggucgauugaag

SEQ ID NO: 26764 - RNA, 21 nt, Artificial Sequence
  Description of Artificial Sequence: Synthetic oligonucleotide
uuucaguaaaggucgauugaa

SEQ ID NO: 26765 - RNA, 21 nt, Artificial Sequence
  Description of Artificial Sequence: Synthetic oligonucleotide
guuucaguaaaggucgauuga

SEQ ID NO: 26766 - RNA, 21 nt, Artificial Sequence
  Description of Artificial Sequence: Synthetic oligonucleotide
uguuucaguaaaggucgauug

SEQ ID NO: 26767 - RNA, 21 nt, Artificial Sequence
  Description of Artificial Sequence: Synthetic oligonucleotide
uuguuucaguaaaggucgauu

SEQ ID NO: 26768 - RNA, 21 nt, Artificial Sequence
  Description of Artificial Sequence: Synthetic oligonucleotide
guuguuucaguaaaggucgau

SEQ ID NO: 26769 - RNA, 21 nt, Artificial Sequence
  Description of Artificial Sequence: Synthetic oligonucleotide
uguuguuucaguaaaggucga

SEQ ID NO: 26770 - RNA, 21 nt, Artificial Sequence
  Description of Artificial Sequence: Synthetic oligonucleotide
cuguuguuucaguaaaggucg

SEQ ID NO: 26771 - RNA, 21 nt, Artificial Sequence
  Description of Artificial Sequence: Synthetic oligonucleotide
acuguuguuucaguaaagguc

SEQ ID NO: 26772 - RNA, 21 nt, Artificial Sequence
  Description of Artificial Sequence: Synthetic oligonucleotide
uacuguuguuucaguaaaggu

SEQ ID NO: 26773 - RNA, 21 nt, Artificial Sequence
  Description of Artificial Sequence: Synthetic oligonucleotide
uuacuguuguuucaguaaagg

SEQ ID NO: 26774 - RNA, 21 nt, Artificial Sequence
  Description of Artificial Sequence: Synthetic oligonucleotide
uuuacuguuguuucaguaaag

SEQ ID NO: 26775 - RNA, 21 nt, Artificial Sequence
  Description of Artificial Sequence: Synthetic oligonucleotide
guuuacuguuguuucaguaaa

SEQ ID NO: 26776 - RNA, 21 nt, Artificial Sequence
  Description of Artificial Sequence: Synthetic oligonucleotide
gguuuacuguuguuucaguaa

SEQ ID NO: 26777 - RNA, 21 nt, Artificial Sequence
  Description of Artificial Sequence: Synthetic oligonucleotide
ugguuuacuguuguuucagua

SEQ ID NO: 26778 - RNA, 21 nt, Artificial Sequence
  Description of Artificial Sequence: Synthetic oligonucleotide
augguuuacuguuguuucagu

SEQ ID NO: 26779 - RNA, 21 nt, Artificial Sequence
  Description of Artificial Sequence: Synthetic oligonucleotide
gaugguuuacuguuguuucag

SEQ ID NO: 26780 - RNA, 21 nt, Artificial Sequence
  Description of Artificial Sequence: Synthetic oligonucleotide
agaugguuuacuguuguuuca

SEQ ID NO: 26781 - RNA, 21 nt, Artificial Sequence
  Description of Artificial Sequence: Synthetic oligonucleotide
aagaugguuuacuguuguuuc

SEQ ID NO: 26782 - RNA, 21 nt, Artificial Sequence
  Description of Artificial Sequence: Synthetic oligonucleotide
aaagaugguuuacuguuguuu

SEQ ID NO: 26783 - RNA, 21 nt, Artificial Sequence
  Description of Artificial Sequence: Synthetic oligonucleotide
uaaagaugguuuacuguuguu

SEQ ID NO: 26784 - RNA, 21 nt, Artificial Sequence
  Description of Artificial Sequence: Synthetic oligonucleotide
auaaagaugguuuacuguugu

SEQ ID NO: 26785 - RNA, 21 nt, Artificial Sequence
  Description of Artificial Sequence: Synthetic oligonucleotide
aauaaagaugguuuacuguug

SEQ ID NO: 26786 - RNA, 21 nt, Artificial Sequence
  Description of Artificial Sequence: Synthetic oligonucleotide
uaauaaagaugguuuacuguu

SEQ ID NO: 26787 - RNA, 21 nt, Artificial Sequence
  Description of Artificial Sequence: Synthetic oligonucleotide
auaauaaagaugguuuacugu

SEQ ID NO: 26788 - RNA, 21 nt, Artificial Sequence
  Description of Artificial Sequence: Synthetic oligonucleotide
cauaauaaagaugguuuacug

SEQ ID NO: 26789 - RNA, 21 nt, Artificial Sequence
  Description of Artificial Sequence: Synthetic oligonucleotide
ccauaauaaagaugguuuacu

SEQ ID NO: 26790 - RNA, 21 nt, Artificial Sequence
  Description of Artificial Sequence: Synthetic oligonucleotide
accauaauaaagaugguuuac

SEQ ID NO: 26791 - RNA, 21 nt, Artificial Sequence
  Description of Artificial Sequence: Synthetic oligonucleotide
gaccauaauaaagaugguuua

SEQ ID NO: 26792 - RNA, 21 nt, Artificial Sequence
  Description of Artificial Sequence: Synthetic oligonucleotide
ugaccauaauaaagaugguuu

SEQ ID NO: 26793 - RNA, 21 nt, Artificial Sequence
  Description of Artificial Sequence: Synthetic oligonucleotide
augaccauaauaaagaugguu

SEQ ID NO: 26794 - RNA, 21 nt, Artificial Sequence
  Description of Artificial Sequence: Synthetic oligonucleotide
uaugaccauaauaaagauggu

SEQ ID NO: 26795 - RNA, 21 nt, Artificial Sequence
  Description of Artificial Sequence: Synthetic oligonucleotide
auaugaccauaauaaagaugg

SEQ ID NO: 26796 - RNA, 21 nt, Artificial Sequence
  Description of Artificial Sequence: Synthetic oligonucleotide
aauaugaccauaauaaagaug

SEQ ID NO: 26797 - RNA, 21 nt, Artificial Sequence
  Description of Artificial Sequence: Synthetic oligonucleotide
aaauaugaccauaauaaagau

SEQ ID NO: 26798 - RNA, 21 nt, Artificial Sequence
  Description of Artificial Sequence: Synthetic oligonucleotide
gaaauaugaccauaauaaaga

SEQ ID NO: 26799 - RNA, 21 nt, Artificial Sequence
  Description of Artificial Sequence: Synthetic oligonucleotide
ugaaauaugaccauaauaaag

SEQ ID NO: 26800 - RNA, 21 nt, Artificial Sequence
  Description of Artificial Sequence: Synthetic oligonucleotide
gugaaauaugaccauaauaaa

SEQ ID NO: 26801 - RNA, 21 nt, Artificial Sequence
  Description of Artificial Sequence: Synthetic oligonucleotide
ugugaaauaugaccauaauaa

SEQ ID NO: 26802 - RNA, 21 nt, Artificial Sequence
  Description of Artificial Sequence: Synthetic oligonucleotide
cugugaaauaugaccauaaua

SEQ ID NO: 26803 - RNA, 21 nt, Artificial Sequence
  Description of Artificial Sequence: Synthetic oligonucleotide
gcugugaaauaugaccauaau

SEQ ID NO: 26804 - RNA, 21 nt, Artificial Sequence
  Description of Artificial Sequence: Synthetic oligonucleotide
ugcugugaaauaugaccauaa

SEQ ID NO: 26805 - RNA, 21 nt, Artificial Sequence
  Description of Artificial Sequence: Synthetic oligonucleotide
gugcugugaaauaugaccaua

SEQ ID NO: 26806 - RNA, 21 nt, Artificial Sequence
  Description of Artificial Sequence: Synthetic oligonucleotide
ggugcugugaaauaugaccau

SEQ ID NO: 26807 - RNA, 21 nt, Artificial Sequence
  Description of Artificial Sequence: Synthetic oligonucleotide
uggugcugugaaauaugacca

SEQ ID NO: 26808 - RNA, 21 nt, Artificial Sequence
  Description of Artificial Sequence: Synthetic oligonucleotide
uuggugcugugaaauaugacc

SEQ ID NO: 26809 - RNA, 21 nt, Artificial Sequence
  Description of Artificial Sequence: Synthetic oligonucleotide
uuuggugcugugaaauaugac

SEQ ID NO: 26810 - RNA, 21 nt, Artificial Sequence
  Description of Artificial Sequence: Synthetic oligonucleotide
uuuuggugcugugaaauauga

SEQ ID NO: 26811 - RNA, 21 nt, Artificial Sequence
  Description of Artificial Sequence: Synthetic oligonucleotide
auuuuggugcugugaaauaug

SEQ ID NO: 26812 - RNA, 21 nt, Artificial Sequence
  Description of Artificial Sequence: Synthetic oligonucleotide
uauuuuggugcugugaaauau

SEQ ID NO: 26813 - RNA, 21 nt, Artificial Sequence
  Description of Artificial Sequence: Synthetic oligonucleotide
uuauuuuggugcugugaaaua

SEQ ID NO: 26814 - RNA, 21 nt, Artificial Sequence
  Description of Artificial Sequence: Synthetic oligonucleotide
uuuauuuuggugcugugaaau

SEQ ID NO: 26815 - RNA, 21 nt, Artificial Sequence
  Description of Artificial Sequence: Synthetic oligonucleotide
auuuauuuuggugcugugaaa

SEQ ID NO: 26816 - RNA, 21 nt, Artificial Sequence
  Description of Artificial Sequence: Synthetic oligonucleotide
gauuuauuuuggugcugugaa

SEQ ID NO: 26817 - RNA, 21 nt, Artificial Sequence
  Description of Artificial Sequence: Synthetic oligonucleotide
ugauuuauuuuggugcuguga

SEQ ID NO: 26818 - RNA, 21 nt, Artificial Sequence
  Description of Artificial Sequence: Synthetic oligonucleotide
augauuuauuuuggugcugug

SEQ ID NO: 26819 - RNA, 21 nt, Artificial Sequence
  Description of Artificial Sequence: Synthetic oligonucleotide
gaugauuuauuuuggugcugu

SEQ ID NO: 26820 - RNA, 21 nt, Artificial Sequence
  Description of Artificial Sequence: Synthetic oligonucleotide
agaugauuuauuuuggugcug

SEQ ID NO: 26821 - RNA, 21 nt, Artificial Sequence
  Description of Artificial Sequence: Synthetic oligonucleotide
aagaugauuuauuuuggugcu

SEQ ID NO: 26822 - RNA, 21 nt, Artificial Sequence
  Description of Artificial Sequence: Synthetic oligonucleotide
aaagaugauuuauuuuggugc

SEQ ID NO: 26823 - RNA, 21 nt, Artificial Sequence
  Description of Artificial Sequence: Synthetic oligonucleotide
uaaagaugauuuauuuuggug

SEQ ID NO: 26824 - RNA, 21 nt, Artificial Sequence
  Description of Artificial Sequence: Synthetic oligonucleotide
auaaagaugauuuauuuuggu

SEQ ID NO: 26825 - RNA, 21 nt, Artificial Sequence
  Description of Artificial Sequence: Synthetic oligonucleotide
aauaaagaugauuuauuuugg

SEQ ID NO: 26826 - RNA, 21 nt, Artificial Sequence
  Description of Artificial Sequence: Synthetic oligonucleotide
uaauaaagaugauuuauuuug

SEQ ID NO: 26827 - RNA, 21 nt, Artificial Sequence
  Description of Artificial Sequence: Synthetic oligonucleotide
uuaauaaagaugauuuauuuu

SEQ ID NO: 26828 - RNA, 21 nt, Artificial Sequence
  Description of Artificial Sequence: Synthetic oligonucleotide
cuuaauaaagaugauuuauuu

SEQ ID NO: 26829 - RNA, 21 nt, Artificial Sequence
  Description of Artificial Sequence: Synthetic oligonucleotide
acuuaauaaagaugauuuauu

SEQ ID NO: 26830 - RNA, 21 nt, Artificial Sequence
  Description of Artificial Sequence: Synthetic oligonucleotide
uacuuaauaaagaugauuuau

SEQ ID NO: 26831 - RNA, 21 nt, Artificial Sequence
  Description of Artificial Sequence: Synthetic oligonucleotide
cuacuuaauaaagaugauuua

SEQ ID NO: 26832 - RNA, 21 nt, Artificial Sequence
  Description of Artificial Sequence: Synthetic oligonucleotide
ucuacuuaauaaagaugauuu

SEQ ID NO: 26833 - RNA, 21 nt, Artificial Sequence
  Description of Artificial Sequence: Synthetic oligonucleotide
aucuacuuaauaaagaugauu

SEQ ID NO: 26834 - RNA, 21 nt, Artificial Sequence
  Description of Artificial Sequence: Synthetic oligonucleotide
caucuacuuaauaaagaugau

SEQ ID NO: 26835 - RNA, 21 nt, Artificial Sequence
  Description of Artificial Sequence: Synthetic oligonucleotide
ucaucuacuuaauaaagauga

SEQ ID NO: 26836 - RNA, 21 nt, Artificial Sequence
  Description of Artificial Sequence: Synthetic oligonucleotide
uucaucuacuuaauaaagaug

SEQ ID NO: 26837 - RNA, 21 nt, Artificial Sequence
  Description of Artificial Sequence: Synthetic oligonucleotide
uuucaucuacuuaauaaagau

SEQ ID NO: 26838 - RNA, 21 nt, Artificial Sequence
  Description of Artificial Sequence: Synthetic oligonucleotide
guuucaucuacuuaauaaaga

SEQ ID NO: 26839 - RNA, 21 nt, Artificial Sequence
  Description of Artificial Sequence: Synthetic oligonucleotide
uguuucaucuacuuaauaaag

SEQ ID NO: 26840 - RNA, 21 nt, Artificial Sequence
  Description of Artificial Sequence: Synthetic oligonucleotide
auguuucaucuacuuaauaaa

SEQ ID NO: 26841 - RNA, 21 nt, Artificial Sequence
  Description of Artificial Sequence: Synthetic oligonucleotide
aauguuucaucuacuuaauaa

SEQ ID NO: 26842 - RNA, 21 nt, Artificial Sequence
  Description of Artificial Sequence: Synthetic oligonucleotide
uaauguuucaucuacuuaaua

SEQ ID NO: 26843 - RNA, 21 nt, Artificial Sequence
  Description of Artificial Sequence: Synthetic oligonucleotide
uuaauguuucaucuacuuaau

SEQ ID NO: 26844 - RNA, 21 nt, Artificial Sequence
  Description of Artificial Sequence: Synthetic oligonucleotide
guuaauguuucaucuacuuaa

SEQ ID NO: 26845 - RNA, 21 nt, Artificial Sequence
  Description of Artificial Sequence: Synthetic oligonucleotide
aguuaauguuucaucuacuua

SEQ ID NO: 26846 - RNA, 21 nt, Artificial Sequence
  Description of Artificial Sequence: Synthetic oligonucleotide
gaguuaauguuucaucuacuu

SEQ ID NO: 26847 - RNA, 21 nt, Artificial Sequence
  Description of Artificial Sequence: Synthetic oligonucleotide
agaguuaauguuucaucuacu

SEQ ID NO: 26848 - RNA, 21 nt, Artificial Sequence
  Description of Artificial Sequence: Synthetic oligonucleotide
uagaguuaauguuucaucuac

SEQ ID NO: 26849 - RNA, 21 nt, Artificial Sequence
  Description of Artificial Sequence: Synthetic oligonucleotide
uuagaguuaauguuucaucua

SEQ ID NO: 26850 - RNA, 21 nt, Artificial Sequence
  Description of Artificial Sequence: Synthetic oligonucleotide
guuagaguuaauguuucaucu

SEQ ID NO: 26851 - RNA, 21 nt, Artificial Sequence
  Description of Artificial Sequence: Synthetic oligonucleotide
aguuagaguuaauguuucauc

SEQ ID NO: 26852 - RNA, 21 nt, Artificial Sequence
  Description of Artificial Sequence: Synthetic oligonucleotide
caguuagaguuaauguuucau

SEQ ID NO: 26853 - RNA, 21 nt, Artificial Sequence
  Description of Artificial Sequence: Synthetic oligonucleotide
acaguuagaguuaauguuuca

SEQ ID NO: 26854 - RNA, 21 nt, Artificial Sequence
  Description of Artificial Sequence: Synthetic oligonucleotide
cacaguuagaguuaauguuuc

SEQ ID NO: 26855 - RNA, 21 nt, Artificial Sequence
  Description of Artificial Sequence: Synthetic oligonucleotide
ucacaguuagaguuaauguuu

SEQ ID NO: 26856 - RNA, 21 nt, Artificial Sequence
  Description of Artificial Sequence: Synthetic oligonucleotide
gucacaguuagaguuaauguu

SEQ ID NO: 26857 - RNA, 21 nt, Artificial Sequence
  Description of Artificial Sequence: Synthetic oligonucleotide
ugucacaguuagaguuaaugu

SEQ ID NO: 26858 - RNA, 21 nt, Artificial Sequence
  Description of Artificial Sequence: Synthetic oligonucleotide
uugucacaguuagaguuaaug

SEQ ID NO: 26859 - RNA, 21 nt, Artificial Sequence
  Description of Artificial Sequence: Synthetic oligonucleotide
uuugucacaguuagaguuaau

SEQ ID NO: 26860 - RNA, 21 nt, Artificial Sequence
  Description of Artificial Sequence: Synthetic oligonucleotide
cuuugucacaguuagaguuaa

SEQ ID NO: 26861 - RNA, 21 nt, Artificial Sequence
  Description of Artificial Sequence: Synthetic oligonucleotide
ucuuugucacaguuagaguua

SEQ ID NO: 26862 - RNA, 21 nt, Artificial Sequence
  Description of Artificial Sequence: Synthetic oligonucleotide
uucuuugucacaguuagaguu

SEQ ID NO: 26863 - RNA, 21 nt, Artificial Sequence
  Description of Artificial Sequence: Synthetic oligonucleotide
cuucuuugucacaguuagagu

SEQ ID NO: 26864 - RNA, 21 nt, Artificial Sequence
  Description of Artificial Sequence: Synthetic oligonucleotide
ucuucuuugucacaguuagag

SEQ ID NO: 26865 - RNA, 21 nt, Artificial Sequence
  Description of Artificial Sequence: Synthetic oligonucleotide
gucuucuuugucacaguuaga

SEQ ID NO: 26866 - RNA, 21 nt, Artificial Sequence
  Description of Artificial Sequence: Synthetic oligonucleotide
ggucuucuuugucacaguuag

SEQ ID NO: 26867 - RNA, 21 nt, Artificial Sequence
  Description of Artificial Sequence: Synthetic oligonucleotide
uggucuucuuugucacaguua

SEQ ID NO: 26868 - RNA, 21 nt, Artificial Sequence
  Description of Artificial Sequence: Synthetic oligonucleotide
guggucuucuuugucacaguu

SEQ ID NO: 26869 - RNA, 21 nt, Artificial Sequence
  Description of Artificial Sequence: Synthetic oligonucleotide
uguggucuucuuugucacagu

SEQ ID NO: 26870 - RNA, 21 nt, Artificial Sequence
  Description of Artificial Sequence: Synthetic oligonucleotide
uuguggucuucuuugucacag

SEQ ID NO: 26871 - RNA, 21 nt, Artificial Sequence
  Description of Artificial Sequence: Synthetic oligonucleotide
uuuguggucuucuuugucaca

SEQ ID NO: 26872 - RNA, 21 nt, Artificial Sequence
  Description of Artificial Sequence: Synthetic oligonucleotide
auuuguggucuucuuugucac

SEQ ID NO: 26873 - RNA, 21 nt, Artificial Sequence
  Description of Artificial Sequence: Synthetic oligonucleotide
uauuuguggucuucuuuguca

SEQ ID NO: 26874 - RNA, 21 nt, Artificial Sequence
  Description of Artificial Sequence: Synthetic oligonucleotide
cuauuuguggucuucuuuguc

SEQ ID NO: 26875 - RNA, 21 nt, Artificial Sequence
  Description of Artificial Sequence: Synthetic oligonucleotide
acuauuuguggucuucuuugu

SEQ ID NO: 26876 - RNA, 21 nt, Artificial Sequence
  Description of Artificial Sequence: Synthetic oligonucleotide
aacuauuuguggucuucuuug

SEQ ID NO: 26877 - RNA, 21 nt, Artificial Sequence
  Description of Artificial Sequence: Synthetic oligonucleotide
uaacuauuuguggucuucuuu

SEQ ID NO: 26878 - RNA, 21 nt, Artificial Sequence
  Description of Artificial Sequence: Synthetic oligonucleotide
auaacuauuuguggucuucuu

SEQ ID NO: 26879 - RNA, 21 nt, Artificial Sequence
  Description of Artificial Sequence: Synthetic oligonucleotide
gauaacuauuuguggucuucu

SEQ ID NO: 26880 - RNA, 21 nt, Artificial Sequence
  Description of Artificial Sequence: Synthetic oligonucleotide
agauaacuauuuguggucuuc

SEQ ID NO: 26881 - RNA, 21 nt, Artificial Sequence
  Description of Artificial Sequence: Synthetic oligonucleotide
aagauaacuauuuguggucuu

SEQ ID NO: 26882 - RNA, 21 nt, Artificial Sequence
  Description of Artificial Sequence: Synthetic oligonucleotide
aaagauaacuauuuguggucu

SEQ ID NO: 26883 - RNA, 21 nt, Artificial Sequence
  Description of Artificial Sequence: Synthetic oligonucleotide
aaaagauaacuauuugugguc

SEQ ID NO: 26884 - RNA, 21 nt, Artificial Sequence
  Description of Artificial Sequence: Synthetic oligonucleotide
uaaaagauaacuauuuguggu

SEQ ID NO: 26885 - RNA, 21 nt, Artificial Sequence
  Description of Artificial Sequence: Synthetic oligonucleotide
uuaaaagauaacuauuugugg

SEQ ID NO: 26886 - RNA, 21 nt, Artificial Sequence
  Description of Artificial Sequence: Synthetic oligonucleotide
auuaaaagauaacuauuugug

SEQ ID NO: 26887 - RNA, 21 nt, Artificial Sequence
  Description of Artificial Sequence: Synthetic oligonucleotide
aauuaaaagauaacuauuugu

SEQ ID NO: 26888 - RNA, 21 nt, Artificial Sequence
  Description of Artificial Sequence: Synthetic oligonucleotide
uaauuaaaagauaacuauuug

SEQ ID NO: 26889 - RNA, 21 nt, Artificial Sequence
  Description of Artificial Sequence: Synthetic oligonucleotide
guaauuaaaagauaacuauuu

SEQ ID NO: 26890 - RNA, 21 nt, Artificial Sequence
  Description of Artificial Sequence: Synthetic oligonucleotide
uguaauuaaaagauaacuauu

SEQ ID NO: 26891 - RNA, 21 nt, Artificial Sequence
  Description of Artificial Sequence: Synthetic oligonucleotide
cuguaauuaaaagauaacuau

SEQ ID NO: 26892 - RNA, 21 nt, Artificial Sequence
  Description of Artificial Sequence: Synthetic oligonucleotide
ucuguaauuaaaagauaacua

SEQ ID NO: 26893 - RNA, 21 nt, Artificial Sequence
  Description of Artificial Sequence: Synthetic oligonucleotide
uucuguaauuaaaagauaacu

SEQ ID NO: 26894 - RNA, 21 nt, Artificial Sequence
  Description of Artificial Sequence: Synthetic oligonucleotide
cuucuguaauuaaaagauaac

SEQ ID NO: 26895 - RNA, 21 nt, Artificial Sequence
  Description of Artificial Sequence: Synthetic oligonucleotide
ucuucuguaauuaaaagauaa

SEQ ID NO: 26896 - RNA, 21 nt, Artificial Sequence
  Description of Artificial Sequence: Synthetic oligonucleotide
cucuucuguaauuaaaagaua

SEQ ID NO: 26897 - RNA, 21 nt, Artificial Sequence
  Description of Artificial Sequence: Synthetic oligonucleotide
acucuucuguaauuaaaagau

SEQ ID NO: 26898 - RNA, 21 nt, Artificial Sequence
  Description of Artificial Sequence: Synthetic oligonucleotide
aacucuucuguaauuaaaaga

SEQ ID NO: 26899 - RNA, 21 nt, Artificial Sequence
  Description of Artificial Sequence: Synthetic oligonucleotide
aaacucuucuguaauuaaaag

SEQ ID NO: 26900 - RNA, 21 nt, Artificial Sequence
  Description of Artificial Sequence: Synthetic oligonucleotide
gaaacucuucuguaauuaaaa

SEQ ID NO: 26901 - RNA, 21 nt, Artificial Sequence
  Description of Artificial Sequence: Synthetic oligonucleotide
agaaacucuucuguaauuaaa

SEQ ID NO: 26902 - RNA, 21 nt, Artificial Sequence
  Description of Artificial Sequence: Synthetic oligonucleotide
aagaaacucuucuguaauuaa

SEQ ID NO: 26903 - RNA, 21 nt, Artificial Sequence
  Description of Artificial Sequence: Synthetic oligonucleotide
uaagaaacucuucuguaauua

SEQ ID NO: 26904 - RNA, 21 nt, Artificial Sequence
  Description of Artificial Sequence: Synthetic oligonucleotide
uuaagaaacucuucuguaauu

SEQ ID NO: 26905 - RNA, 21 nt, Artificial Sequence
  Description of Artificial Sequence: Synthetic oligonucleotide
guuaagaaacucuucuguaau

SEQ ID NO: 26906 - RNA, 21 nt, Artificial Sequence
  Description of Artificial Sequence: Synthetic oligonucleotide
aguuaagaaacucuucuguaa

SEQ ID NO: 26907 - RNA, 21 nt, Artificial Sequence
  Description of Artificial Sequence: Synthetic oligonucleotide
aaguuaagaaacucuucugua

SEQ ID NO: 26908 - RNA, 21 nt, Artificial Sequence
  Description of Artificial Sequence: Synthetic oligonucleotide
uaaguuaagaaacucuucugu

SEQ ID NO: 26909 - RNA, 21 nt, Artificial Sequence
  Description of Artificial Sequence: Synthetic oligonucleotide
guaaguuaagaaacucuucug

SEQ ID NO: 26910 - RNA, 21 nt, Artificial Sequence
  Description of Artificial Sequence: Synthetic oligonucleotide
aguaaguuaagaaacucuucu

SEQ ID NO: 26911 - RNA, 21 nt, Artificial Sequence
  Description of Artificial Sequence: Synthetic oligonucleotide
aaguaaguuaagaaacucuuc

SEQ ID NO: 26912 - RNA, 21 nt, Artificial Sequence
  Description of Artificial Sequence: Synthetic oligonucleotide
aaaguaaguuaagaaacucuu

SEQ ID NO: 26913 - RNA, 21 nt, Artificial Sequence
  Description of Artificial Sequence: Synthetic oligonucleotide
aaaaguaaguuaagaaacucu

SEQ ID NO: 26914 - RNA, 21 nt, Artificial Sequence
  Description of Artificial Sequence: Synthetic oligonucleotide
caaaaguaaguuaagaaacuc

SEQ ID NO: 26915 - RNA, 21 nt, Artificial Sequence
  Description of Artificial Sequence: Synthetic oligonucleotide
acaaaaguaaguuaagaaacu

SEQ ID NO: 26916 - RNA, 21 nt, Artificial Sequence
  Description of Artificial Sequence: Synthetic oligonucleotide
uacaaaaguaaguuaagaaac

SEQ ID NO: 26917 - RNA, 21 nt, Artificial Sequence
  Description of Artificial Sequence: Synthetic oligonucleotide
uuacaaaaguaaguuaagaaa

SEQ ID NO: 26918 - RNA, 21 nt, Artificial Sequence
  Description of Artificial Sequence: Synthetic oligonucleotide
cuuacaaaaguaaguuaagaa

SEQ ID NO: 26919 - RNA, 21 nt, Artificial Sequence
  Description of Artificial Sequence: Synthetic oligonucleotide
acuuacaaaaguaaguuaaga

SEQ ID NO: 26920 - RNA, 21 nt, Artificial Sequence
  Description of Artificial Sequence: Synthetic oligonucleotide
aacuuacaaaaguaaguuaag

SEQ ID NO: 26921 - RNA, 21 nt, Artificial Sequence
  Description of Artificial Sequence: Synthetic oligonucleotide
aaacuuacaaaaguaaguuaa

SEQ ID NO: 26922 - RNA, 21 nt, Artificial Sequence
  Description of Artificial Sequence: Synthetic oligonucleotide
aaaacuuacaaaaguaaguua

SEQ ID NO: 26923 - RNA, 21 nt, Artificial Sequence
  Description of Artificial Sequence: Synthetic oligonucleotide
aaaaacuuacaaaaguaaguu

SEQ ID NO: 26924 - RNA, 21 nt, Artificial Sequence
  Description of Artificial Sequence: Synthetic oligonucleotide
uaaaaacuuacaaaaguaagu

SEQ ID NO: 26925 - RNA, 21 nt, Artificial Sequence
  Description of Artificial Sequence: Synthetic oligonucleotide
auaaaaacuuacaaaaguaag

SEQ ID NO: 26926 - RNA, 21 nt, Artificial Sequence
  Description of Artificial Sequence: Synthetic oligonucleotide
aauaaaaacuuacaaaaguaa

SEQ ID NO: 26927 - RNA, 21 nt, Artificial Sequence
  Description of Artificial Sequence: Synthetic oligonucleotide
caauaaaaacuuacaaaagua

SEQ ID NO: 26928 - RNA, 21 nt, Artificial Sequence
  Description of Artificial Sequence: Synthetic oligonucleotide
acaauaaaaacuuacaaaagu

SEQ ID NO: 26929 - RNA, 21 nt, Artificial Sequence
  Description of Artificial Sequence: Synthetic oligonucleotide
cacaauaaaaacuuacaaaag

SEQ ID NO: 26930 - RNA, 21 nt, Artificial Sequence
  Description of Artificial Sequence: Synthetic oligonucleotide
acacaauaaaaacuuacaaaa

SEQ ID NO: 26931 - RNA, 21 nt, Artificial Sequence
  Description of Artificial Sequence: Synthetic oligonucleotide
uacacaauaaaaacuuacaaa

SEQ ID NO: 26932 - RNA, 21 nt, Artificial Sequence
  Description of Artificial Sequence: Synthetic oligonucleotide
uuacacaauaaaaacuuacaa

SEQ ID NO: 26933 - RNA, 21 nt, Artificial Sequence
  Description of Artificial Sequence: Synthetic oligonucleotide
cuuacacaauaaaaacuuaca

SEQ ID NO: 26934 - RNA, 21 nt, Artificial Sequence
  Description of Artificial Sequence: Synthetic oligonucleotide
acuuacacaauaaaaacuuac

SEQ ID NO: 26935 - RNA, 21 nt, Artificial Sequence
  Description of Artificial Sequence: Synthetic oligonucleotide
aacuuacacaauaaaaacuua

SEQ ID NO: 26936 - RNA, 21 nt, Artificial Sequence
  Description of Artificial Sequence: Synthetic oligonucleotide
aaacuuacacaauaaaaacuu

SEQ ID NO: 26937 - RNA, 21 nt, Artificial Sequence
  Description of Artificial Sequence: Synthetic oligonucleotide
uaaacuuacacaauaaaaacu

SEQ ID NO: 26938 - RNA, 21 nt, Artificial Sequence
  Description of Artificial Sequence: Synthetic oligonucleotide
auaaacuuacacaauaaaaac

SEQ ID NO: 26939 - RNA, 21 nt, Artificial Sequence
  Description of Artificial Sequence: Synthetic oligonucleotide
uauaaacuuacacaauaaaaa

SEQ ID NO: 26940 - RNA, 21 nt, Artificial Sequence
  Description of Artificial Sequence: Synthetic oligonucleotide
uuauaaacuuacacaauaaaa

SEQ ID NO: 26941 - RNA, 21 nt, Artificial Sequence
  Description of Artificial Sequence: Synthetic oligonucleotide
auuauaaacuuacacaauaaa

SEQ ID NO: 26942 - RNA, 21 nt, Artificial Sequence
  Description of Artificial Sequence: Synthetic oligonucleotide
cauuauaaacuuacacaauaa

SEQ ID NO: 26943 - RNA, 21 nt, Artificial Sequence
  Description of Artificial Sequence: Synthetic oligonucleotide
gcauuauaaacuuacacaaua

SEQ ID NO: 26944 - RNA, 21 nt, Artificial Sequence
  Description of Artificial Sequence: Synthetic oligonucleotide
ugcauuauaaacuuacacaau

SEQ ID NO: 26945 - RNA, 21 nt, Artificial Sequence
  Description of Artificial Sequence: Synthetic oligonucleotide
cugcauuauaaacuuacacaa

SEQ ID NO: 26946 - RNA, 21 nt, Artificial Sequence
  Description of Artificial Sequence: Synthetic oligonucleotide
ccugcauuauaaacuuacaca

SEQ ID NO: 26947 - RNA, 21 nt, Artificial Sequence
  Description of Artificial Sequence: Synthetic oligonucleotide
cccugcauuauaaacuuacac

SEQ ID NO: 26948 - RNA, 21 nt, Artificial Sequence
  Description of Artificial Sequence: Synthetic oligonucleotide
ccccugcauuauaaacuuaca

SEQ ID NO: 26949 - RNA, 21 nt, Artificial Sequence
  Description of Artificial Sequence: Synthetic oligonucleotide
uccccugcauuauaaacuuac

SEQ ID NO: 26950 - RNA, 21 nt, Artificial Sequence
  Description of Artificial Sequence: Synthetic oligonucleotide
uuccccugcauuauaaacuua

SEQ ID NO: 26951 - RNA, 21 nt, Artificial Sequence
  Description of Artificial Sequence: Synthetic oligonucleotide
cuuccccugcauuauaaacuu

SEQ ID NO: 26952 - RNA, 21 nt, Artificial Sequence
  Description of Artificial Sequence: Synthetic oligonucleotide
acuuccccugcauuauaaacu

SEQ ID NO: 26953 - RNA, 21 nt, Artificial Sequence
  Description of Artificial Sequence: Synthetic oligonucleotide
uacuuccccugcauuauaaac

SEQ ID NO: 26954 - RNA, 21 nt, Artificial Sequence
  Description of Artificial Sequence: Synthetic oligonucleotide
guacuuccccugcauuauaaa

SEQ ID NO: 26955 - RNA, 21 nt, Artificial Sequence
  Description of Artificial Sequence: Synthetic oligonucleotide
aguacuuccccugcauuauaa

SEQ ID NO: 26956 - RNA, 21 nt, Artificial Sequence
  Description of Artificial Sequence: Synthetic oligonucleotide
uaguacuuccccugcauuaua

SEQ ID NO: 26957 - RNA, 21 nt, Artificial Sequence
  Description of Artificial Sequence: Synthetic oligonucleotide
guaguacuuccccugcauuau

SEQ ID NO: 26958 - RNA, 21 nt, Artificial Sequence
  Description of Artificial Sequence: Synthetic oligonucleotide
aguaguacuuccccugcauua

SEQ ID NO: 26959 - RNA, 21 nt, Artificial Sequence
  Description of Artificial Sequence: Synthetic oligonucleotide
gaguaguacuuccccugcauu

SEQ ID NO: 26960 - RNA, 21 nt, Artificial Sequence
  Description of Artificial Sequence: Synthetic oligonucleotide
ggaguaguacuuccccugcau

SEQ ID NO: 26961 - RNA, 21 nt, Artificial Sequence
  Description of Artificial Sequence: Synthetic oligonucleotide
aggaguaguacuuccccugca

SEQ ID NO: 26962 - RNA, 21 nt, Artificial Sequence
  Description of Artificial Sequence: Synthetic oligonucleotide
gaggaguaguacuuccccugc

SEQ ID NO: 26963 - RNA, 21 nt, Artificial Sequence
  Description of Artificial Sequence: Synthetic oligonucleotide
ugaggaguaguacuuccccug

SEQ ID NO: 26964 - RNA, 21 nt, Artificial Sequence
  Description of Artificial Sequence: Synthetic oligonucleotide
uugaggaguaguacuuccccu

SEQ ID NO: 26965 - RNA, 21 nt, Artificial Sequence
  Description of Artificial Sequence: Synthetic oligonucleotide
uuugaggaguaguacuucccc

SEQ ID NO: 26966 - RNA, 21 nt, Artificial Sequence
  Description of Artificial Sequence: Synthetic oligonucleotide
auuugaggaguaguacuuccc

SEQ ID NO: 26967 - RNA, 21 nt, Artificial Sequence
  Description of Artificial Sequence: Synthetic oligonucleotide
cauuugaggaguaguacuucc

SEQ ID NO: 26968 - RNA, 21 nt, Artificial Sequence
  Description of Artificial Sequence: Synthetic oligonucleotide
acauuugaggaguaguacuuc

SEQ ID NO: 26969 - RNA, 21 nt, Artificial Sequence
  Description of Artificial Sequence: Synthetic oligonucleotide
aacauuugaggaguaguacuu

SEQ ID NO: 26970 - RNA, 21 nt, Artificial Sequence
  Description of Artificial Sequence: Synthetic oligonucleotide
caacauuugaggaguaguacu

SEQ ID NO: 26971 - RNA, 21 nt, Artificial Sequence
  Description of Artificial Sequence: Synthetic oligonucleotide
ucaacauuugaggaguaguac

SEQ ID NO: 26972 - RNA, 21 nt, Artificial Sequence
  Description of Artificial Sequence: Synthetic oligonucleotide
cucaacauuugaggaguagua

SEQ ID NO: 26973 - RNA, 21 nt, Artificial Sequence
  Description of Artificial Sequence: Synthetic oligonucleotide
ccucaacauuugaggaguagu

SEQ ID NO: 26974 - RNA, 21 nt, Artificial Sequence
  Description of Artificial Sequence: Synthetic oligonucleotide
cccucaacauuugaggaguag

SEQ ID NO: 26975 - RNA, 21 nt, Artificial Sequence
  Description of Artificial Sequence: Synthetic oligonucleotide
ucccucaacauuugaggagua

SEQ ID NO: 26976 - RNA, 21 nt, Artificial Sequence
  Description of Artificial Sequence: Synthetic oligonucleotide
uucccucaacauuugaggagu

SEQ ID NO: 26977 - RNA, 21 nt, Artificial Sequence
  Description of Artificial Sequence: Synthetic oligonucleotide
cuucccucaacauuugaggag

SEQ ID NO: 26978 - RNA, 21 nt, Artificial Sequence
  Description of Artificial Sequence: Synthetic oligonucleotide
gcuucccucaacauuugagga

SEQ ID NO: 26979 - RNA, 21 nt, Artificial Sequence
  Description of Artificial Sequence: Synthetic oligonucleotide
agcuucccucaacauuugagg

SEQ ID NO: 26980 - RNA, 21 nt, Artificial Sequence
  Description of Artificial Sequence: Synthetic oligonucleotide
aagcuucccucaacauuugag

SEQ ID NO: 26981 - RNA, 21 nt, Artificial Sequence
  Description of Artificial Sequence: Synthetic oligonucleotide
gaagcuucccucaacauuuga

SEQ ID NO: 26982 - RNA, 21 nt, Artificial Sequence
  Description of Artificial Sequence: Synthetic oligonucleotide
ggaagcuucccucaacauuug

SEQ ID NO: 26983 - RNA, 21 nt, Artificial Sequence
  Description of Artificial Sequence: Synthetic oligonucleotide
uggaagcuucccucaacauuu

SEQ ID NO: 26984 - RNA, 21 nt, Artificial Sequence
  Description of Artificial Sequence: Synthetic oligonucleotide
auggaagcuucccucaacauu

SEQ ID NO: 26985 - RNA, 21 nt, Artificial Sequence
  Description of Artificial Sequence: Synthetic oligonucleotide
uauggaagcuucccucaacau

SEQ ID NO: 26986 - RNA, 21 nt, Artificial Sequence
  Description of Artificial Sequence: Synthetic oligonucleotide
uuauggaagcuucccucaaca

SEQ ID NO: 26987 - RNA, 21 nt, Artificial Sequence
  Description of Artificial Sequence: Synthetic oligonucleotide
guuauggaagcuucccucaac

SEQ ID NO: 26988 - RNA, 21 nt, Artificial Sequence
  Description of Artificial Sequence: Synthetic oligonucleotide
uguuauggaagcuucccucaa

SEQ ID NO: 26989 - RNA, 21 nt, Artificial Sequence
  Description of Artificial Sequence: Synthetic oligonucleotide
auguuauggaagcuucccuca

SEQ ID NO: 26990 - RNA, 21 nt, Artificial Sequence
  Description of Artificial Sequence: Synthetic oligonucleotide
aauguuauggaagcuucccuc

SEQ ID NO: 26991 - RNA, 21 nt, Artificial Sequence
  Description of Artificial Sequence: Synthetic oligonucleotide
caauguuauggaagcuucccu

SEQ ID NO: 26992 - RNA, 21 nt, Artificial Sequence
  Description of Artificial Sequence: Synthetic oligonucleotide
ucaauguuauggaagcuuccc

SEQ ID NO: 26993 - RNA, 21 nt, Artificial Sequence
  Description of Artificial Sequence: Synthetic oligonucleotide
aucaauguuauggaagcuucc

SEQ ID NO: 26994 - RNA, 21 nt, Artificial Sequence
  Description of Artificial Sequence: Synthetic oligonucleotide
caucaauguuauggaagcuuc

SEQ ID NO: 26995 - RNA, 21 nt, Artificial Sequence
  Description of Artificial Sequence: Synthetic oligonucleotide
ucaucaauguuauggaagcuu

SEQ ID NO: 26996 - RNA, 21 nt, Artificial Sequence
  Description of Artificial Sequence: Synthetic oligonucleotide
gucaucaauguuauggaagcu

SEQ ID NO: 26997 - RNA, 21 nt, Artificial Sequence
  Description of Artificial Sequence: Synthetic oligonucleotide
agucaucaauguuauggaagc

SEQ ID NO: 26998 - RNA, 21 nt, Artificial Sequence
  Description of Artificial Sequence: Synthetic oligonucleotide
cagucaucaauguuauggaag

SEQ ID NO: 26999 - RNA, 21 nt, Artificial Sequence
  Description of Artificial Sequence: Synthetic oligonucleotide
ccagucaucaauguuauggaa

SEQ ID NO: 27000 - RNA, 21 nt, Artificial Sequence
  Description of Artificial Sequence: Synthetic oligonucleotide
gccagucaucaauguuaugga

SEQ ID NO: 27001 - RNA, 21 nt, Artificial Sequence
  Description of Artificial Sequence: Synthetic oligonucleotide
agccagucaucaauguuaugg

SEQ ID NO: 27002 - RNA, 21 nt, Artificial Sequence
  Description of Artificial Sequence: Synthetic oligonucleotide
aagccagucaucaauguuaug

SEQ ID NO: 27003 - RNA, 21 nt, Artificial Sequence
  Description of Artificial Sequence: Synthetic oligonucleotide
gaagccagucaucaauguuau

SEQ ID NO: 27004 - RNA, 21 nt, Artificial Sequence
  Description of Artificial Sequence: Synthetic oligonucleotide
ugaagccagucaucaauguua

SEQ ID NO: 27005 - RNA, 21 nt, Artificial Sequence
  Description of Artificial Sequence: Synthetic oligonucleotide
augaagccagucaucaauguu

SEQ ID NO: 27006 - RNA, 21 nt, Artificial Sequence
  Description of Artificial Sequence: Synthetic oligonucleotide
caugaagccagucaucaaugu

SEQ ID NO: 27007 - RNA, 21 nt, Artificial Sequence
  Description of Artificial Sequence: Synthetic oligonucleotide
ccaugaagccagucaucaaug

SEQ ID NO: 27008 - RNA, 21 nt, Artificial Sequence
  Description of Artificial Sequence: Synthetic oligonucleotide
gccaugaagccagucaucaau

SEQ ID NO: 27009 - RNA, 21 nt, Artificial Sequence
  Description of Artificial Sequence: Synthetic oligonucleotide
ugccaugaagccagucaucaa

SEQ ID NO: 27010 - RNA, 21 nt, Artificial Sequence
  Description of Artificial Sequence: Synthetic oligonucleotide
cugccaugaagccagucauca

SEQ ID NO: 27011 - RNA, 21 nt, Artificial Sequence
  Description of Artificial Sequence: Synthetic oligonucleotide
acugccaugaagccagucauc

SEQ ID NO: 27012 - RNA, 21 nt, Artificial Sequence
  Description of Artificial Sequence: Synthetic oligonucleotide
uacugccaugaagccagucau

SEQ ID NO: 27013 - RNA, 21 nt, Artificial Sequence
  Description of Artificial Sequence: Synthetic oligonucleotide
uuacugccaugaagccaguca

SEQ ID NO: 27014 - RNA, 21 nt, Artificial Sequence
  Description of Artificial Sequence: Synthetic oligonucleotide
auuacugccaugaagccaguc

SEQ ID NO: 27015 - RNA, 21 nt, Artificial Sequence
  Description of Artificial Sequence: Synthetic oligonucleotide
aauuacugccaugaagccagu

SEQ ID NO: 27016 - RNA, 21 nt, Artificial Sequence
  Description of Artificial Sequence: Synthetic oligonucleotide
gaauuacugccaugaagccag

SEQ ID NO: 27017 - RNA, 21 nt, Artificial Sequence
  Description of Artificial Sequence: Synthetic oligonucleotide
agaauuacugccaugaagcca

SEQ ID NO: 27018 - RNA, 21 nt, Artificial Sequence
  Description of Artificial Sequence: Synthetic oligonucleotide
gagaauuacugccaugaagcc

SEQ ID NO: 27019 - RNA, 21 nt, Artificial Sequence
  Description of Artificial Sequence: Synthetic oligonucleotide
cgagaauuacugccaugaagc

SEQ ID NO: 27020 - RNA, 21 nt, Artificial Sequence
  Description of Artificial Sequence: Synthetic oligonucleotide
ccgagaauuacugccaugaag

SEQ ID NO: 27021 - RNA, 21 nt, Artificial Sequence
  Description of Artificial Sequence: Synthetic oligonucleotide
gccgagaauuacugccaugaa

SEQ ID NO: 27022 - RNA, 21 nt, Artificial Sequence
  Description of Artificial Sequence: Synthetic oligonucleotide
agccgagaauuacugccauga

SEQ ID NO: 27023 - RNA, 21 nt, Artificial Sequence
  Description of Artificial Sequence: Synthetic oligonucleotide
cagccgagaauuacugccaug

SEQ ID NO: 27024 - RNA, 21 nt, Artificial Sequence
  Description of Artificial Sequence: Synthetic oligonucleotide
acagccgagaauuacugccau

SEQ ID NO: 27025 - RNA, 21 nt, Artificial Sequence
  Description of Artificial Sequence: Synthetic oligonucleotide
uacagccgagaauuacugcca

SEQ ID NO: 27026 - RNA, 21 nt, Artificial Sequence
  Description of Artificial Sequence: Synthetic oligonucleotide
cuacagccgagaauuacugcc

SEQ ID NO: 27027 - RNA, 21 nt, Artificial Sequence
  Description of Artificial Sequence: Synthetic oligonucleotide
acuacagccgagaauuacugc

SEQ ID NO: 27028 - RNA, 21 nt, Artificial Sequence
  Description of Artificial Sequence: Synthetic oligonucleotide
aacuacagccgagaauuacug

SEQ ID NO: 27029 - RNA, 21 nt, Artificial Sequence
  Description of Artificial Sequence: Synthetic oligonucleotide
caacuacagccgagaauuacu

SEQ ID NO: 27030 - RNA, 21 nt, Artificial Sequence
  Description of Artificial Sequence: Synthetic oligonucleotide
gcaacuacagccgagaauuac

SEQ ID NO: 27031 - RNA, 21 nt, Artificial Sequence
  Description of Artificial Sequence: Synthetic oligonucleotide
ugcaacuacagccgagaauua

SEQ ID NO: 27032 - RNA, 21 nt, Artificial Sequence
  Description of Artificial Sequence: Synthetic oligonucleotide
augcaacuacagccgagaauu

SEQ ID NO: 27033 - RNA, 21 nt, Artificial Sequence
  Description of Artificial Sequence: Synthetic oligonucleotide
uaugcaacuacagccgagaau

SEQ ID NO: 27034 - RNA, 21 nt, Artificial Sequence
  Description of Artificial Sequence: Synthetic oligonucleotide
uuaugcaacuacagccgagaa

SEQ ID NO: 27035 - RNA, 21 nt, Artificial Sequence
  Description of Artificial Sequence: Synthetic oligonucleotide
cuuaugcaacuacagccgaga

SEQ ID NO: 27036 - RNA, 21 nt, Artificial Sequence
  Description of Artificial Sequence: Synthetic oligonucleotide
gcuuaugcaacuacagccgag

SEQ ID NO: 27037 - RNA, 21 nt, Artificial Sequence
  Description of Artificial Sequence: Synthetic oligonucleotide
ugcuuaugcaacuacagccga

SEQ ID NO: 27038 - RNA, 21 nt, Artificial Sequence
  Description of Artificial Sequence: Synthetic oligonucleotide
augcuuaugcaacuacagccg

SEQ ID NO: 27039 - RNA, 21 nt, Artificial Sequence
  Description of Artificial Sequence: Synthetic oligonucleotide
aaugcuuaugcaacuacagcc

SEQ ID NO: 27040 - RNA, 21 nt, Artificial Sequence
  Description of Artificial Sequence: Synthetic oligonucleotide
caaugcuuaugcaacuacagc

SEQ ID NO: 27041 - RNA, 21 nt, Artificial Sequence
  Description of Artificial Sequence: Synthetic oligonucleotide
gcaaugcuuaugcaacuacag

SEQ ID NO: 27042 - RNA, 21 nt, Artificial Sequence
  Description of Artificial Sequence: Synthetic oligonucleotide
agcaaugcuuaugcaacuaca

SEQ ID NO: 27043 - RNA, 21 nt, Artificial Sequence
  Description of Artificial Sequence: Synthetic oligonucleotide
gagcaaugcuuaugcaacuac

SEQ ID NO: 27044 - RNA, 21 nt, Artificial Sequence
  Description of Artificial Sequence: Synthetic oligonucleotide
ugagcaaugcuuaugcaacua

SEQ ID NO: 27045 - RNA, 21 nt, Artificial Sequence
  Description of Artificial Sequence: Synthetic oligonucleotide
uugagcaaugcuuaugcaacu

SEQ ID NO: 27046 - RNA, 21 nt, Artificial Sequence
  Description of Artificial Sequence: Synthetic oligonucleotide
cuugagcaaugcuuaugcaac

SEQ ID NO: 27047 - RNA, 21 nt, Artificial Sequence
  Description of Artificial Sequence: Synthetic oligonucleotide
ucuugagcaaugcuuaugcaa

SEQ ID NO: 27048 - RNA, 21 nt, Artificial Sequence
  Description of Artificial Sequence: Synthetic oligonucleotide
cucuugagcaaugcuuaugca

SEQ ID NO: 27049 - RNA, 21 nt, Artificial Sequence
  Description of Artificial Sequence: Synthetic oligonucleotide
ccucuugagcaaugcuuaugc

SEQ ID NO: 27050 - RNA, 21 nt, Artificial Sequence
  Description of Artificial Sequence: Synthetic oligonucleotide
uccucuugagcaaugcuuaug

SEQ ID NO: 27051 - RNA, 21 nt, Artificial Sequence
  Description of Artificial Sequence: Synthetic oligonucleotide
uuccucuugagcaaugcuuau

SEQ ID NO: 27052 - RNA, 21 nt, Artificial Sequence
  Description of Artificial Sequence: Synthetic oligonucleotide
uuuccucuugagcaaugcuua

SEQ ID NO: 27053 - RNA, 21 nt, Artificial Sequence
  Description of Artificial Sequence: Synthetic oligonucleotide
uuuuccucuugagcaaugcuu

SEQ ID NO: 27054 - RNA, 21 nt, Artificial Sequence
  Description of Artificial Sequence: Synthetic oligonucleotide
auuuuccucuugagcaaugcu

SEQ ID NO: 27055 - RNA, 21 nt, Artificial Sequence
  Description of Artificial Sequence: Synthetic oligonucleotide
gauuuuccucuugagcaaugc

SEQ ID NO: 27056 - RNA, 21 nt, Artificial Sequence
  Description of Artificial Sequence: Synthetic oligonucleotide
ggauuuuccucuugagcaaug

SEQ ID NO: 27057 - RNA, 21 nt, Artificial Sequence
  Description of Artificial Sequence: Synthetic oligonucleotide
uggauuuuccucuugagcaau

SEQ ID NO: 27058 - RNA, 21 nt, Artificial Sequence
  Description of Artificial Sequence: Synthetic oligonucleotide
uuggauuuuccucuugagcaa

SEQ ID NO: 27059 - RNA, 21 nt, Artificial Sequence
  Description of Artificial Sequence: Synthetic oligonucleotide
uuuggauuuuccucuugagca

SEQ ID NO: 27060 - RNA, 21 nt, Artificial Sequence
  Description of Artificial Sequence: Synthetic oligonucleotide
uuuuggauuuuccucuugagc

SEQ ID NO: 27061 - RNA, 21 nt, Artificial Sequence
  Description of Artificial Sequence: Synthetic oligonucleotide
cuuuuggauuuuccucuugag

SEQ ID NO: 27062 - RNA, 21 nt, Artificial Sequence
  Description of Artificial Sequence: Synthetic oligonucleotide
acuuuuggauuuuccucuuga

SEQ ID NO: 27063 - RNA, 21 nt, Artificial Sequence
  Description of Artificial Sequence: Synthetic oligonucleotide
cacuuuuggauuuuccucuug

SEQ ID NO: 27064 - RNA, 21 nt, Artificial Sequence
  Description of Artificial Sequence: Synthetic oligonucleotide
gcacuuuuggauuuuccucuu

SEQ ID NO: 27065 - RNA, 21 nt, Artificial Sequence
  Description of Artificial Sequence: Synthetic oligonucleotide
ugcacuuuuggauuuuccucu

SEQ ID NO: 27066 - RNA, 21 nt, Artificial Sequence
  Description of Artificial Sequence: Synthetic oligonucleotide
cugcacuuuuggauuuuccuc

SEQ ID NO: 27067 - RNA, 21 nt, Artificial Sequence
  Description of Artificial Sequence: Synthetic oligonucleotide
gcugcacuuuuggauuuuccu

SEQ ID NO: 27068 - RNA, 21 nt, Artificial Sequence
  Description of Artificial Sequence: Synthetic oligonucleotide
ugcugcacuuuuggauuuucc

SEQ ID NO: 27069 - RNA, 21 nt, Artificial Sequence
  Description of Artificial Sequence: Synthetic oligonucleotide
cugcugcacuuuuggauuuuc

SEQ ID NO: 27070 - RNA, 21 nt, Artificial Sequence
  Description of Artificial Sequence: Synthetic oligonucleotide
ccugcugcacuuuuggauuuu

SEQ ID NO: 27071 - RNA, 21 nt, Artificial Sequence
  Description of Artificial Sequence: Synthetic oligonucleotide
uccugcugcacuuuuggauuu

SEQ ID NO: 27072 - RNA, 21 nt, Artificial Sequence
  Description of Artificial Sequence: Synthetic oligonucleotide
cuccugcugcacuuuuggauu

SEQ ID NO: 27073 - RNA, 21 nt, Artificial Sequence
  Description of Artificial Sequence: Synthetic oligonucleotide
ucuccugcugcacuuuuggau

SEQ ID NO: 27074 - RNA, 21 nt, Artificial Sequence
  Description of Artificial Sequence: Synthetic oligonucleotide
uucuccugcugcacuuuugga

SEQ ID NO: 27075 - RNA, 21 nt, Artificial Sequence
  Description of Artificial Sequence: Synthetic oligonucleotide
guucuccugcugcacuuuugg

SEQ ID NO: 27076 - RNA, 21 nt, Artificial Sequence
  Description of Artificial Sequence: Synthetic oligonucleotide
aguucuccugcugcacuuuug

SEQ ID NO: 27077 - RNA, 21 nt, Artificial Sequence
  Description of Artificial Sequence: Synthetic oligonucleotide
gaguucuccugcugcacuuuu

SEQ ID NO: 27078 - RNA, 21 nt, Artificial Sequence
  Description of Artificial Sequence: Synthetic oligonucleotide
agaguucuccugcugcacuuu

SEQ ID NO: 27079 - RNA, 21 nt, Artificial Sequence
  Description of Artificial Sequence: Synthetic oligonucleotide
aagaguucuccugcugcacuu

SEQ ID NO: 27080 - RNA, 21 nt, Artificial Sequence
  Description of Artificial Sequence: Synthetic oligonucleotide
aaagaguucuccugcugcacu

SEQ ID NO: 27081 - RNA, 21 nt, Artificial Sequence
  Description of Artificial Sequence: Synthetic oligonucleotide
aaaagaguucuccugcugcac

SEQ ID NO: 27082 - RNA, 21 nt, Artificial Sequence
  Description of Artificial Sequence: Synthetic oligonucleotide
gaaaagaguucuccugcugca

SEQ ID NO: 27083 - RNA, 21 nt, Artificial Sequence
  Description of Artificial Sequence: Synthetic oligonucleotide
ggaaaagaguucuccugcugc

SEQ ID NO: 27084 - RNA, 21 nt, Artificial Sequence
  Description of Artificial Sequence: Synthetic oligonucleotide
gggaaaagaguucuccugcug

SEQ ID NO: 27085 - RNA, 21 nt, Artificial Sequence
  Description of Artificial Sequence: Synthetic oligonucleotide
agggaaaagaguucuccugcu

SEQ ID NO: 27086 - RNA, 21 nt, Artificial Sequence
  Description of Artificial Sequence: Synthetic oligonucleotide
cagggaaaagaguucuccugc

SEQ ID NO: 27087 - RNA, 21 nt, Artificial Sequence
  Description of Artificial Sequence: Synthetic oligonucleotide
ucagggaaaagaguucuccug

SEQ ID NO: 27088 - RNA, 21 nt, Artificial Sequence
  Description of Artificial Sequence: Synthetic oligonucleotide
uucagggaaaagaguucuccu

SEQ ID NO: 27089 - RNA, 21 nt, Artificial Sequence
  Description of Artificial Sequence: Synthetic oligonucleotide
uuucagggaaaagaguucucc

SEQ ID NO: 27090 - RNA, 21 nt, Artificial Sequence
  Description of Artificial Sequence: Synthetic oligonucleotide
uuuucagggaaaagaguucuc

SEQ ID NO: 27091 - RNA, 21 nt, Artificial Sequence
  Description of Artificial Sequence: Synthetic oligonucleotide
uuuuucagggaaaagaguucu

SEQ ID NO: 27092 - RNA, 21 nt, Artificial Sequence
  Description of Artificial Sequence: Synthetic oligonucleotide
cuuuuucagggaaaagaguuc

SEQ ID NO: 27093 - RNA, 21 nt, Artificial Sequence
  Description of Artificial Sequence: Synthetic oligonucleotide
ccuuuuucagggaaaagaguu

SEQ ID NO: 27094 - RNA, 21 nt, Artificial Sequence
  Description of Artificial Sequence: Synthetic oligonucleotide
uccuuuuucagggaaaagagu

SEQ ID NO: 27095 - RNA, 21 nt, Artificial Sequence
  Description of Artificial Sequence: Synthetic oligonucleotide
uuccuuuuucagggaaaagag

SEQ ID NO: 27096 - RNA, 21 nt, Artificial Sequence
  Description of Artificial Sequence: Synthetic oligonucleotide
uuuccuuuuucagggaaaaga

SEQ ID NO: 27097 - RNA, 21 nt, Artificial Sequence
  Description of Artificial Sequence: Synthetic oligonucleotide
uuuuccuuuuucagggaaaag

SEQ ID NO: 27098 - RNA, 21 nt, Artificial Sequence
  Description of Artificial Sequence: Synthetic oligonucleotide
uuuuuccuuuuucagggaaaa

SEQ ID NO: 27099 - RNA, 21 nt, Artificial Sequence
  Description of Artificial Sequence: Synthetic oligonucleotide
auuuuuccuuuuucagggaaa

SEQ ID NO: 27100 - RNA, 21 nt, Artificial Sequence
  Description of Artificial Sequence: Synthetic oligonucleotide
uauuuuuccuuuuucagggaa

SEQ ID NO: 27101 - RNA, 21 nt, Artificial Sequence
  Description of Artificial Sequence: Synthetic oligonucleotide
auauuuuuccuuuuucaggga

SEQ ID NO: 27102 - RNA, 21 nt, Artificial Sequence
  Description of Artificial Sequence: Synthetic oligonucleotide
aauauuuuuccuuuuucaggg

SEQ ID NO: 27103 - RNA, 21 nt, Artificial Sequence
  Description of Artificial Sequence: Synthetic oligonucleotide
caauauuuuuccuuuuucagg

SEQ ID NO: 27104 - RNA, 21 nt, Artificial Sequence
  Description of Artificial Sequence: Synthetic oligonucleotide
ucaauauuuuuccuuuuucag

SEQ ID NO: 27105 - RNA, 21 nt, Artificial Sequence
  Description of Artificial Sequence: Synthetic oligonucleotide
uucaauauuuuuccuuuuuca

SEQ ID NO: 27106 - RNA, 21 nt, Artificial Sequence
  Description of Artificial Sequence: Synthetic oligonucleotide
guucaauauuuuuccuuuuuc

SEQ ID NO: 27107 - RNA, 21 nt, Artificial Sequence
  Description of Artificial Sequence: Synthetic oligonucleotide
aguucaauauuuuuccuuuuu

SEQ ID NO: 27108 - RNA, 21 nt, Artificial Sequence
  Description of Artificial Sequence: Synthetic oligonucleotide
gaguucaauauuuuuccuuuu

SEQ ID NO: 27109 - RNA, 21 nt, Artificial Sequence
  Description of Artificial Sequence: Synthetic oligonucleotide
ugaguucaauauuuuuccuuu

SEQ ID NO: 27110 - RNA, 21 nt, Artificial Sequence
  Description of Artificial Sequence: Synthetic oligonucleotide
uugaguucaauauuuuuccuu

SEQ ID NO: 27111 - RNA, 21 nt, Artificial Sequence
  Description of Artificial Sequence: Synthetic oligonucleotide
auugaguucaauauuuuuccu

SEQ ID NO: 27112 - RNA, 21 nt, Artificial Sequence
  Description of Artificial Sequence: Synthetic oligonucleotide
cauugaguucaauauuuuucc

SEQ ID NO: 27113 - RNA, 21 nt, Artificial Sequence
  Description of Artificial Sequence: Synthetic oligonucleotide
ucauugaguucaauauuuuuc

SEQ ID NO: 27114 - RNA, 21 nt, Artificial Sequence
  Description of Artificial Sequence: Synthetic oligonucleotide
aucauugaguucaauauuuuu

SEQ ID NO: 27115 - RNA, 21 nt, Artificial Sequence
  Description of Artificial Sequence: Synthetic oligonucleotide
uaucauugaguucaauauuuu

SEQ ID NO: 27116 - RNA, 21 nt, Artificial Sequence
  Description of Artificial Sequence: Synthetic oligonucleotide
cuaucauugaguucaauauuu

SEQ ID NO: 27117 - RNA, 21 nt, Artificial Sequence
  Description of Artificial Sequence: Synthetic oligonucleotide
gcuaucauugaguucaauauu

SEQ ID NO: 27118 - RNA, 21 nt, Artificial Sequence
  Description of Artificial Sequence: Synthetic oligonucleotide
ugcuaucauugaguucaauau

SEQ ID NO: 27119 - RNA, 21 nt, Artificial Sequence
  Description of Artificial Sequence: Synthetic oligonucleotide
gugcuaucauugaguucaaua

SEQ ID NO: 27120 - RNA, 21 nt, Artificial Sequence
  Description of Artificial Sequence: Synthetic oligonucleotide
ggugcuaucauugaguucaau

SEQ ID NO: 27121 - RNA, 21 nt, Artificial Sequence
  Description of Artificial Sequence: Synthetic oligonucleotide
aggugcuaucauugaguucaa

SEQ ID NO: 27122 - RNA, 21 nt, Artificial Sequence
  Description of Artificial Sequence: Synthetic oligonucleotide
uaggugcuaucauugaguuca

SEQ ID NO: 27123 - RNA, 21 nt, Artificial Sequence
  Description of Artificial Sequence: Synthetic oligonucleotide
uuaggugcuaucauugaguuc

SEQ ID NO: 27124 - RNA, 21 nt, Artificial Sequence
  Description of Artificial Sequence: Synthetic oligonucleotide
uuuaggugcuaucauugaguu

SEQ ID NO: 27125 - RNA, 21 nt, Artificial Sequence
  Description of Artificial Sequence: Synthetic oligonucleotide
guuuaggugcuaucauugagu

SEQ ID NO: 27126 - RNA, 21 nt, Artificial Sequence
  Description of Artificial Sequence: Synthetic oligonucleotide
aguuuaggugcuaucauugag

SEQ ID NO: 27127 - RNA, 21 nt, Artificial Sequence
  Description of Artificial Sequence: Synthetic oligonucleotide
aaguuuaggugcuaucauuga

SEQ ID NO: 27128 - RNA, 21 nt, Artificial Sequence
  Description of Artificial Sequence: Synthetic oligonucleotide
uaaguuuaggugcuaucauug

SEQ ID NO: 27129 - RNA, 21 nt, Artificial Sequence
  Description of Artificial Sequence: Synthetic oligonucleotide
guaaguuuaggugcuaucauu

SEQ ID NO: 27130 - RNA, 21 nt, Artificial Sequence
  Description of Artificial Sequence: Synthetic oligonucleotide
uguaaguuuaggugcuaucau

SEQ ID NO: 27131 - RNA, 21 nt, Artificial Sequence
  Description of Artificial Sequence: Synthetic oligonucleotide
auguaaguuuaggugcuauca

SEQ ID NO: 27132 - RNA, 21 nt, Artificial Sequence
  Description of Artificial Sequence: Synthetic oligonucleotide
aauguaaguuuaggugcuauc

SEQ ID NO: 27133 - RNA, 21 nt, Artificial Sequence
  Description of Artificial Sequence: Synthetic oligonucleotide
aaauguaaguuuaggugcuau

SEQ ID NO: 27134 - RNA, 21 nt, Artificial Sequence
  Description of Artificial Sequence: Synthetic oligonucleotide
uaaauguaaguuuaggugcua

SEQ ID NO: 27135 - RNA, 21 nt, Artificial Sequence
  Description of Artificial Sequence: Synthetic oligonucleotide
uuaaauguaaguuuaggugcu

SEQ ID NO: 27136 - RNA, 21 nt, Artificial Sequence
  Description of Artificial Sequence: Synthetic oligonucleotide
uuuaaauguaaguuuaggugc

SEQ ID NO: 27137 - RNA, 21 nt, Artificial Sequence
  Description of Artificial Sequence: Synthetic oligonucleotide
uuuuaaauguaaguuuaggug

SEQ ID NO: 27138 - RNA, 21 nt, Artificial Sequence
  Description of Artificial Sequence: Synthetic oligonucleotide
cuuuuaaauguaaguuuaggu

SEQ ID NO: 27139 - RNA, 21 nt, Artificial Sequence
  Description of Artificial Sequence: Synthetic oligonucleotide
ucuuuuaaauguaaguuuagg

SEQ ID NO: 27140 - RNA, 21 nt, Artificial Sequence
  Description of Artificial Sequence: Synthetic oligonucleotide
gucuuuuaaauguaaguuuag

SEQ ID NO: 27141 - RNA, 21 nt, Artificial Sequence
  Description of Artificial Sequence: Synthetic oligonucleotide
ugucuuuuaaauguaaguuua

SEQ ID NO: 27142 - RNA, 21 nt, Artificial Sequence
  Description of Artificial Sequence: Synthetic oligonucleotide
cugucuuuuaaauguaaguuu

SEQ ID NO: 27143 - RNA, 21 nt, Artificial Sequence
  Description of Artificial Sequence: Synthetic oligonucleotide
ucugucuuuuaaauguaaguu

SEQ ID NO: 27144 - RNA, 21 nt, Artificial Sequence
  Description of Artificial Sequence: Synthetic oligonucleotide
gucugucuuuuaaauguaagu

SEQ ID NO: 27145 - RNA, 21 nt, Artificial Sequence
  Description of Artificial Sequence: Synthetic oligonucleotide
ugucugucuuuuaaauguaag

SEQ ID NO: 27146 - RNA, 21 nt, Artificial Sequence
  Description of Artificial Sequence: Synthetic oligonucleotide
augucugucuuuuaaauguaa

SEQ ID NO: 27147 - RNA, 21 nt, Artificial Sequence
  Description of Artificial Sequence: Synthetic oligonucleotide
aaugucugucuuuuaaaugua

SEQ ID NO: 27148 - RNA, 21 nt, Artificial Sequence
  Description of Artificial Sequence: Synthetic oligonucleotide
gaaugucugucuuuuaaaugu

SEQ ID NO: 27149 - RNA, 21 nt, Artificial Sequence
  Description of Artificial Sequence: Synthetic oligonucleotide
ggaaugucugucuuuuaaaug

SEQ ID NO: 27150 - RNA, 21 nt, Artificial Sequence
  Description of Artificial Sequence: Synthetic oligonucleotide
aggaaugucugucuuuuaaau

SEQ ID NO: 27151 - RNA, 21 nt, Artificial Sequence
  Description of Artificial Sequence: Synthetic oligonucleotide
aaggaaugucugucuuuuaaa

SEQ ID NO: 27152 - RNA, 21 nt, Artificial Sequence
  Description of Artificial Sequence: Synthetic oligonucleotide
gaaggaaugucugucuuuuaa

SEQ ID NO: 27153 - RNA, 21 nt, Artificial Sequence
  Description of Artificial Sequence: Synthetic oligonucleotide
agaaggaaugucugucuuuua

SEQ ID NO: 27154 - RNA, 21 nt, Artificial Sequence
  Description of Artificial Sequence: Synthetic oligonucleotide
uagaaggaaugucugucuuuu

SEQ ID NO: 27155 - RNA, 21 nt, Artificial Sequence
  Description of Artificial Sequence: Synthetic oligonucleotide
guagaaggaaugucugucuuu

SEQ ID NO: 27156 - RNA, 21 nt, Artificial Sequence
  Description of Artificial Sequence: Synthetic oligonucleotide
uguagaaggaaugucugucuu

SEQ ID NO: 27157 - RNA, 21 nt, Artificial Sequence
  Description of Artificial Sequence: Synthetic oligonucleotide
auguagaaggaaugucugucu

SEQ ID NO: 27158 - RNA, 21 nt, Artificial Sequence
  Description of Artificial Sequence: Synthetic oligonucleotide
cauguagaaggaaugucuguc

SEQ ID NO: 27159 - RNA, 21 nt, Artificial Sequence
  Description of Artificial Sequence: Synthetic oligonucleotide
acauguagaaggaaugucugu

SEQ ID NO: 27160 - RNA, 21 nt, Artificial Sequence
  Description of Artificial Sequence: Synthetic oligonucleotide
uacauguagaaggaaugucug

SEQ ID NO: 27161 - RNA, 21 nt, Artificial Sequence
  Description of Artificial Sequence: Synthetic oligonucleotide
uuacauguagaaggaaugucu

SEQ ID NO: 27162 - RNA, 21 nt, Artificial Sequence
  Description of Artificial Sequence: Synthetic oligonucleotide
auuacauguagaaggaauguc

SEQ ID NO: 27163 - RNA, 21 nt, Artificial Sequence
  Description of Artificial Sequence: Synthetic oligonucleotide
cauuacauguagaaggaaugu

SEQ ID NO: 27164 - RNA, 21 nt, Artificial Sequence
  Description of Artificial Sequence: Synthetic oligonucleotide
ucauuacauguagaaggaaug

SEQ ID NO: 27165 - RNA, 21 nt, Artificial Sequence
  Description of Artificial Sequence: Synthetic oligonucleotide
gucauuacauguagaaggaau

SEQ ID NO: 27166 - RNA, 21 nt, Artificial Sequence
  Description of Artificial Sequence: Synthetic oligonucleotide
ugucauuacauguagaaggaa

SEQ ID NO: 27167 - RNA, 21 nt, Artificial Sequence
  Description of Artificial Sequence: Synthetic oligonucleotide
gugucauuacauguagaagga

SEQ ID NO: 27168 - RNA, 21 nt, Artificial Sequence
  Description of Artificial Sequence: Synthetic oligonucleotide
agugucauuacauguagaagg

SEQ ID NO: 27169 - RNA, 21 nt, Artificial Sequence
  Description of Artificial Sequence: Synthetic oligonucleotide
aagugucauuacauguagaag

SEQ ID NO: 27170 - RNA, 21 nt, Artificial Sequence
  Description of Artificial Sequence: Synthetic oligonucleotide
gaagugucauuacauguagaa

SEQ ID NO: 27171 - RNA, 21 nt, Artificial Sequence
  Description of Artificial Sequence: Synthetic oligonucleotide
agaagugucauuacauguaga

SEQ ID NO: 27172 - RNA, 21 nt, Artificial Sequence
  Description of Artificial Sequence: Synthetic oligonucleotide
aagaagugucauuacauguag

SEQ ID NO: 27173 - RNA, 21 nt, Artificial Sequence
  Description of Artificial Sequence: Synthetic oligonucleotide
caagaagugucauuacaugua

SEQ ID NO: 27174 - RNA, 21 nt, Artificial Sequence
  Description of Artificial Sequence: Synthetic oligonucleotide
acaagaagugucauuacaugu

SEQ ID NO: 27175 - RNA, 21 nt, Artificial Sequence
  Description of Artificial Sequence: Synthetic oligonucleotide
cacaagaagugucauuacaug

SEQ ID NO: 27176 - RNA, 21 nt, Artificial Sequence
  Description of Artificial Sequence: Synthetic oligonucleotide
acacaagaagugucauuacau

SEQ ID NO: 27177 - RNA, 21 nt, Artificial Sequence
  Description of Artificial Sequence: Synthetic oligonucleotide
aacacaagaagugucauuaca

SEQ ID NO: 27178 - RNA, 21 nt, Artificial Sequence
  Description of Artificial Sequence: Synthetic oligonucleotide
uaacacaagaagugucauuac

SEQ ID NO: 27179 - RNA, 21 nt, Artificial Sequence
  Description of Artificial Sequence: Synthetic oligonucleotide
uuaacacaagaagugucauua

SEQ ID NO: 27180 - RNA, 21 nt, Artificial Sequence
  Description of Artificial Sequence: Synthetic oligonucleotide
uuuaacacaagaagugucauu

SEQ ID NO: 27181 - RNA, 21 nt, Artificial Sequence
  Description of Artificial Sequence: Synthetic oligonucleotide
guuuaacacaagaagugucau

SEQ ID NO: 27182 - RNA, 21 nt, Artificial Sequence
  Description of Artificial Sequence: Synthetic oligonucleotide
aguuuaacacaagaaguguca

SEQ ID NO: 27183 - RNA, 21 nt, Artificial Sequence
  Description of Artificial Sequence: Synthetic oligonucleotide
uaguuuaacacaagaaguguc

SEQ ID NO: 27184 - RNA, 21 nt, Artificial Sequence
  Description of Artificial Sequence: Synthetic oligonucleotide
uuaguuuaacacaagaagugu

SEQ ID NO: 27185 - RNA, 21 nt, Artificial Sequence
  Description of Artificial Sequence: Synthetic oligonucleotide
uuuaguuuaacacaagaagug

SEQ ID NO: 27186 - RNA, 21 nt, Artificial Sequence
  Description of Artificial Sequence: Synthetic oligonucleotide
uuuuaguuuaacacaagaagu

SEQ ID NO: 27187 - RNA, 21 nt, Artificial Sequence
  Description of Artificial Sequence: Synthetic oligonucleotide
uuuuuaguuuaacacaagaag

SEQ ID NO: 27188 - RNA, 21 nt, Artificial Sequence
  Description of Artificial Sequence: Synthetic oligonucleotide
auuuuuaguuuaacacaagaa

SEQ ID NO: 27189 - RNA, 21 nt, Artificial Sequence
  Description of Artificial Sequence: Synthetic oligonucleotide
aauuuuuaguuuaacacaaga

SEQ ID NO: 27190 - RNA, 21 nt, Artificial Sequence
  Description of Artificial Sequence: Synthetic oligonucleotide
aaauuuuuaguuuaacacaag

SEQ ID NO: 27191 - RNA, 21 nt, Artificial Sequence
  Description of Artificial Sequence: Synthetic oligonucleotide
uaaauuuuuaguuuaacacaa

SEQ ID NO: 27192 - RNA, 21 nt, Artificial Sequence
  Description of Artificial Sequence: Synthetic oligonucleotide
guaaauuuuuaguuuaacaca

SEQ ID NO: 27193 - RNA, 21 nt, Artificial Sequence
  Description of Artificial Sequence: Synthetic oligonucleotide
uguaaauuuuuaguuuaacac

SEQ ID NO: 27194 - RNA, 21 nt, Artificial Sequence
  Description of Artificial Sequence: Synthetic oligonucleotide
uuguaaauuuuuaguuuaaca

SEQ ID NO: 27195 - RNA, 21 nt, Artificial Sequence
  Description of Artificial Sequence: Synthetic oligonucleotide
cuuguaaauuuuuaguuuaac

SEQ ID NO: 27196 - RNA, 21 nt, Artificial Sequence
  Description of Artificial Sequence: Synthetic oligonucleotide
ucuuguaaauuuuuaguuuaa

SEQ ID NO: 27197 - RNA, 21 nt, Artificial Sequence
  Description of Artificial Sequence: Synthetic oligonucleotide
cucuuguaaauuuuuaguuua

SEQ ID NO: 27198 - RNA, 21 nt, Artificial Sequence
  Description of Artificial Sequence: Synthetic oligonucleotide
ucucuuguaaauuuuuaguuu

SEQ ID NO: 27199 - RNA, 21 nt, Artificial Sequence
  Description of Artificial Sequence: Synthetic oligonucleotide
uucucuuguaaauuuuuaguu

SEQ ID NO: 27200 - RNA, 21 nt, Artificial Sequence
  Description of Artificial Sequence: Synthetic oligonucleotide
cuucucuuguaaauuuuuagu

SEQ ID NO: 27201 - RNA, 21 nt, Artificial Sequence
  Description of Artificial Sequence: Synthetic oligonucleotide
ucuucucuuguaaauuuuuag

SEQ ID NO: 27202 - RNA, 21 nt, Artificial Sequence
  Description of Artificial Sequence: Synthetic oligonucleotide
uucuucucuuguaaauuuuua

SEQ ID NO: 27203 - RNA, 21 nt, Artificial Sequence
  Description of Artificial Sequence: Synthetic oligonucleotide
uuucuucucuuguaaauuuuu

SEQ ID NO: 27204 - RNA, 21 nt, Artificial Sequence
  Description of Artificial Sequence: Synthetic oligonucleotide
cuuucuucucuuguaaauuuu

SEQ ID NO: 27205 - RNA, 21 nt, Artificial Sequence
  Description of Artificial Sequence: Synthetic oligonucleotide
acuuucuucucuuguaaauuu

SEQ ID NO: 27206 - RNA, 21 nt, Artificial Sequence
  Description of Artificial Sequence: Synthetic oligonucleotide
cacuuucuucucuuguaaauu

SEQ ID NO: 27207 - RNA, 21 nt, Artificial Sequence
  Description of Artificial Sequence: Synthetic oligonucleotide
ucacuuucuucucuuguaaau

SEQ ID NO: 27208 - RNA, 21 nt, Artificial Sequence
  Description of Artificial Sequence: Synthetic oligonucleotide
uucacuuucuucucuuguaaa

SEQ ID NO: 27209 - RNA, 21 nt, Artificial Sequence
  Description of Artificial Sequence: Synthetic oligonucleotide
uuucacuuucuucucuuguaa

SEQ ID NO: 27210 - RNA, 21 nt, Artificial Sequence
  Description of Artificial Sequence: Synthetic oligonucleotide
cuuucacuuucuucucuugua

SEQ ID NO: 27211 - RNA, 21 nt, Artificial Sequence
  Description of Artificial Sequence: Synthetic oligonucleotide
gcuuucacuuucuucucuugu

SEQ ID NO: 27212 - RNA, 21 nt, Artificial Sequence
  Description of Artificial Sequence: Synthetic oligonucleotide
ugcuuucacuuucuucucuug

SEQ ID NO: 27213 - RNA, 21 nt, Artificial Sequence
  Description of Artificial Sequence: Synthetic oligonucleotide
uugcuuucacuuucuucucuu

SEQ ID NO: 27214 - RNA, 21 nt, Artificial Sequence
  Description of Artificial Sequence: Synthetic oligonucleotide
uuugcuuucacuuucuucucu

SEQ ID NO: 27215 - RNA, 21 nt, Artificial Sequence
  Description of Artificial Sequence: Synthetic oligonucleotide
auuugcuuucacuuucuucuc

SEQ ID NO: 27216 - RNA, 21 nt, Artificial Sequence
  Description of Artificial Sequence: Synthetic oligonucleotide
cauuugcuuucacuuucuucu

SEQ ID NO: 27217 - RNA, 21 nt, Artificial Sequence
  Description of Artificial Sequence: Synthetic oligonucleotide
ccauuugcuuucacuuucuuc

SEQ ID NO: 27218 - RNA, 21 nt, Artificial Sequence
  Description of Artificial Sequence: Synthetic oligonucleotide
cccauuugcuuucacuuucuu

SEQ ID NO: 27219 - RNA, 21 nt, Artificial Sequence
  Description of Artificial Sequence: Synthetic oligonucleotide
ccccauuugcuuucacuuucu

SEQ ID NO: 27220 - RNA, 21 nt, Artificial Sequence
  Description of Artificial Sequence: Synthetic oligonucleotide
accccauuugcuuucacuuuc

SEQ ID NO: 27221 - RNA, 21 nt, Artificial Sequence
  Description of Artificial Sequence: Synthetic oligonucleotide
aaccccauuugcuuucacuuu

SEQ ID NO: 27222 - RNA, 21 nt, Artificial Sequence
  Description of Artificial Sequence: Synthetic oligonucleotide
aaaccccauuugcuuucacuu

SEQ ID NO: 27223 - RNA, 21 nt, Artificial Sequence
  Description of Artificial Sequence: Synthetic oligonucleotide
gaaaccccauuugcuuucacu

SEQ ID NO: 27224 - RNA, 21 nt, Artificial Sequence
  Description of Artificial Sequence: Synthetic oligonucleotide
ugaaaccccauuugcuuucac

SEQ ID NO: 27225 - RNA, 21 nt, Artificial Sequence
  Description of Artificial Sequence: Synthetic oligonucleotide
gugaaaccccauuugcuuuca

SEQ ID NO: 27226 - RNA, 21 nt, Artificial Sequence
  Description of Artificial Sequence: Synthetic oligonucleotide
ugugaaaccccauuugcuuuc

SEQ ID NO: 27227 - RNA, 21 nt, Artificial Sequence
  Description of Artificial Sequence: Synthetic oligonucleotide
uugugaaaccccauuugcuuu

SEQ ID NO: 27228 - RNA, 21 nt, Artificial Sequence
  Description of Artificial Sequence: Synthetic oligonucleotide
uuugugaaaccccauuugcuu

SEQ ID NO: 27229 - RNA, 21 nt, Artificial Sequence
  Description of Artificial Sequence: Synthetic oligonucleotide
auuugugaaaccccauuugcu

SEQ ID NO: 27230 - RNA, 21 nt, Artificial Sequence
  Description of Artificial Sequence: Synthetic oligonucleotide
uauuugugaaaccccauuugc

SEQ ID NO: 27231 - RNA, 21 nt, Artificial Sequence
  Description of Artificial Sequence: Synthetic oligonucleotide
cuauuugugaaaccccauuug

SEQ ID NO: 27232 - RNA, 21 nt, Artificial Sequence
  Description of Artificial Sequence: Synthetic oligonucleotide
acuauuugugaaaccccauuu

SEQ ID NO: 27233 - RNA, 21 nt, Artificial Sequence
  Description of Artificial Sequence: Synthetic oligonucleotide
aacuauuugugaaaccccauu

SEQ ID NO: 27234 - RNA, 21 nt, Artificial Sequence
  Description of Artificial Sequence: Synthetic oligonucleotide
caacuauuugugaaaccccau

SEQ ID NO: 27235 - RNA, 21 nt, Artificial Sequence
  Description of Artificial Sequence: Synthetic oligonucleotide
acaacuauuugugaaacccca

SEQ ID NO: 27236 - RNA, 21 nt, Artificial Sequence
  Description of Artificial Sequence: Synthetic oligonucleotide
uacaacuauuugugaaacccc

SEQ ID NO: 27237 - RNA, 21 nt, Artificial Sequence
  Description of Artificial Sequence: Synthetic oligonucleotide
uuacaacuauuugugaaaccc

SEQ ID NO: 27238 - RNA, 21 nt, Artificial Sequence
  Description of Artificial Sequence: Synthetic oligonucleotide
uuuacaacuauuugugaaacc

SEQ ID NO: 27239 - RNA, 21 nt, Artificial Sequence
  Description of Artificial Sequence: Synthetic oligonucleotide
auuuacaacuauuugugaaac

SEQ ID NO: 27240 - RNA, 21 nt, Artificial Sequence
  Description of Artificial Sequence: Synthetic oligonucleotide
uauuuacaacuauuugugaaa

SEQ ID NO: 27241 - RNA, 21 nt, Artificial Sequence
  Description of Artificial Sequence: Synthetic oligonucleotide
auauuuacaacuauuugugaa

SEQ ID NO: 27242 - RNA, 21 nt, Artificial Sequence
  Description of Artificial Sequence: Synthetic oligonucleotide
uauauuuacaacuauuuguga

SEQ ID NO: 27243 - RNA, 21 nt, Artificial Sequence
  Description of Artificial Sequence: Synthetic oligonucleotide
cuauauuuacaacuauuugug

SEQ ID NO: 27244 - RNA, 21 nt, Artificial Sequence
  Description of Artificial Sequence: Synthetic oligonucleotide
acuauauuuacaacuauuugu

SEQ ID NO: 27245 - RNA, 21 nt, Artificial Sequence
  Description of Artificial Sequence: Synthetic oligonucleotide
cacuauauuuacaacuauuug

SEQ ID NO: 27246 - RNA, 21 nt, Artificial Sequence
  Description of Artificial Sequence: Synthetic oligonucleotide
ucacuauauuuacaacuauuu

SEQ ID NO: 27247 - RNA, 21 nt, Artificial Sequence
  Description of Artificial Sequence: Synthetic oligonucleotide
uucacuauauuuacaacuauu

SEQ ID NO: 27248 - RNA, 21 nt, Artificial Sequence
  Description of Artificial Sequence: Synthetic oligonucleotide
cuucacuauauuuacaacuau

SEQ ID NO: 27249 - RNA, 21 nt, Artificial Sequence
  Description of Artificial Sequence: Synthetic oligonucleotide
gcuucacuauauuuacaacua

SEQ ID NO: 27250 - RNA, 21 nt, Artificial Sequence
  Description of Artificial Sequence: Synthetic oligonucleotide
ugcuucacuauauuuacaacu

SEQ ID NO: 27251 - RNA, 21 nt, Artificial Sequence
  Description of Artificial Sequence: Synthetic oligonucleotide
uugcuucacuauauuuacaac

SEQ ID NO: 27252 - RNA, 21 nt, Artificial Sequence
  Description of Artificial Sequence: Synthetic oligonucleotide
auugcuucacuauauuuacaa

SEQ ID NO: 27253 - RNA, 21 nt, Artificial Sequence
  Description of Artificial Sequence: Synthetic oligonucleotide
aauugcuucacuauauuuaca

SEQ ID NO: 27254 - RNA, 21 nt, Artificial Sequence
  Description of Artificial Sequence: Synthetic oligonucleotide
aaauugcuucacuauauuuac

SEQ ID NO: 27255 - RNA, 21 nt, Artificial Sequence
  Description of Artificial Sequence: Synthetic oligonucleotide
caaauugcuucacuauauuua

SEQ ID NO: 27256 - RNA, 21 nt, Artificial Sequence
  Description of Artificial Sequence: Synthetic oligonucleotide
ucaaauugcuucacuauauuu

SEQ ID NO: 27257 - RNA, 21 nt, Artificial Sequence
  Description of Artificial Sequence: Synthetic oligonucleotide
uucaaauugcuucacuauauu

SEQ ID NO: 27258 - RNA, 21 nt, Artificial Sequence
  Description of Artificial Sequence: Synthetic oligonucleotide
uuucaaauugcuucacuauau

SEQ ID NO: 27259 - RNA, 21 nt, Artificial Sequence
  Description of Artificial Sequence: Synthetic oligonucleotide
auuucaaauugcuucacuaua

SEQ ID NO: 27260 - RNA, 21 nt, Artificial Sequence
  Description of Artificial Sequence: Synthetic oligonucleotide
uauuucaaauugcuucacuau

SEQ ID NO: 27261 - RNA, 21 nt, Artificial Sequence
  Description of Artificial Sequence: Synthetic oligonucleotide
uuauuucaaauugcuucacua

SEQ ID NO: 27262 - RNA, 21 nt, Artificial Sequence
  Description of Artificial Sequence: Synthetic oligonucleotide
auuauuucaaauugcuucacu

SEQ ID NO: 27263 - RNA, 21 nt, Artificial Sequence
  Description of Artificial Sequence: Synthetic oligonucleotide
aauuauuucaaauugcuucac

SEQ ID NO: 27264 - RNA, 21 nt, Artificial Sequence
  Description of Artificial Sequence: Synthetic oligonucleotide
aaauuauuucaaauugcuuca

SEQ ID NO: 27265 - RNA, 21 nt, Artificial Sequence
  Description of Artificial Sequence: Synthetic oligonucleotide
aaaauuauuucaaauugcuuc

SEQ ID NO: 27266 - RNA, 21 nt, Artificial Sequence
  Description of Artificial Sequence: Synthetic oligonucleotide
gaaaauuauuucaaauugcuu

SEQ ID NO: 27267 - RNA, 21 nt, Artificial Sequence
  Description of Artificial Sequence: Synthetic oligonucleotide
ugaaaauuauuucaaauugcu

SEQ ID NO: 27268 - RNA, 21 nt, Artificial Sequence
  Description of Artificial Sequence: Synthetic oligonucleotide
uugaaaauuauuucaaauugc

SEQ ID NO: 27269 - RNA, 21 nt, Artificial Sequence
  Description of Artificial Sequence: Synthetic oligonucleotide
cuugaaaauuauuucaaauug

SEQ ID NO: 27270 - RNA, 21 nt, Artificial Sequence
  Description of Artificial Sequence: Synthetic oligonucleotide
gcuugaaaauuauuucaaauu

SEQ ID NO: 27271 - RNA, 21 nt, Artificial Sequence
  Description of Artificial Sequence: Synthetic oligonucleotide
ugcuugaaaauuauuucaaau

SEQ ID NO: 27272 - RNA, 21 nt, Artificial Sequence
  Description of Artificial Sequence: Synthetic oligonucleotide
uugcuugaaaauuauuucaaa

SEQ ID NO: 27273 - RNA, 21 nt, Artificial Sequence
  Description of Artificial Sequence: Synthetic oligonucleotide
uuugcuugaaaauuauuucaa

SEQ ID NO: 27274 - RNA, 21 nt, Artificial Sequence
  Description of Artificial Sequence: Synthetic oligonucleotide
cuuugcuugaaaauuauuuca

SEQ ID NO: 27275 - RNA, 21 nt, Artificial Sequence
  Description of Artificial Sequence: Synthetic oligonucleotide
acuuugcuugaaaauuauuuc

SEQ ID NO: 27276 - RNA, 21 nt, Artificial Sequence
  Description of Artificial Sequence: Synthetic oligonucleotide
uacuuugcuugaaaauuauuu

SEQ ID NO: 27277 - RNA, 21 nt, Artificial Sequence
  Description of Artificial Sequence: Synthetic oligonucleotide
auacuuugcuugaaaauuauu

SEQ ID NO: 27278 - RNA, 21 nt, Artificial Sequence
  Description of Artificial Sequence: Synthetic oligonucleotide
aauacuuugcuugaaaauuau

SEQ ID NO: 27279 - RNA, 21 nt, Artificial Sequence
  Description of Artificial Sequence: Synthetic oligonucleotide
caauacuuugcuugaaaauua

SEQ ID NO: 27280 - RNA, 21 nt, Artificial Sequence
  Description of Artificial Sequence: Synthetic oligonucleotide
acaauacuuugcuugaaaauu

SEQ ID NO: 27281 - RNA, 21 nt, Artificial Sequence
  Description of Artificial Sequence: Synthetic oligonucleotide
cacaauacuuugcuugaaaau

SEQ ID NO: 27282 - RNA, 21 nt, Artificial Sequence
  Description of Artificial Sequence: Synthetic oligonucleotide
ucacaauacuuugcuugaaaa

SEQ ID NO: 27283 - RNA, 21 nt, Artificial Sequence
  Description of Artificial Sequence: Synthetic oligonucleotide
uucacaauacuuugcuugaaa

SEQ ID NO: 27284 - RNA, 21 nt, Artificial Sequence
  Description of Artificial Sequence: Synthetic oligonucleotide
uuucacaauacuuugcuugaa

SEQ ID NO: 27285 - RNA, 21 nt, Artificial Sequence
  Description of Artificial Sequence: Synthetic oligonucleotide
cuuucacaauacuuugcuuga

SEQ ID NO: 27286 - RNA, 21 nt, Artificial Sequence
  Description of Artificial Sequence: Synthetic oligonucleotide
acuuucacaauacuuugcuug

SEQ ID NO: 27287 - RNA, 21 nt, Artificial Sequence
  Description of Artificial Sequence: Synthetic oligonucleotide
uacuuucacaauacuuugcuu

SEQ ID NO: 27288 - RNA, 21 nt, Artificial Sequence
  Description of Artificial Sequence: Synthetic oligonucleotide
auacuuucacaauacuuugcu

SEQ ID NO: 27289 - RNA, 21 nt, Artificial Sequence
  Description of Artificial Sequence: Synthetic oligonucleotide
aauacuuucacaauacuuugc

SEQ ID NO: 27290 - RNA, 21 nt, Artificial Sequence
  Description of Artificial Sequence: Synthetic oligonucleotide
gaauacuuucacaauacuuug

SEQ ID NO: 27291 - RNA, 21 nt, Artificial Sequence
  Description of Artificial Sequence: Synthetic oligonucleotide
agaauacuuucacaauacuuu

SEQ ID NO: 27292 - RNA, 21 nt, Artificial Sequence
  Description of Artificial Sequence: Synthetic oligonucleotide
uagaauacuuucacaauacuu

SEQ ID NO: 27293 - RNA, 21 nt, Artificial Sequence
  Description of Artificial Sequence: Synthetic oligonucleotide
uuagaauacuuucacaauacu

SEQ ID NO: 27294 - RNA, 21 nt, Artificial Sequence
  Description of Artificial Sequence: Synthetic oligonucleotide
cuuagaauacuuucacaauac

SEQ ID NO: 27295 - RNA, 21 nt, Artificial Sequence
  Description of Artificial Sequence: Synthetic oligonucleotide
gcuuagaauacuuucacaaua

SEQ ID NO: 27296 - RNA, 21 nt, Artificial Sequence
  Description of Artificial Sequence: Synthetic oligonucleotide
ggcuuagaauacuuucacaau

SEQ ID NO: 27297 - RNA, 21 nt, Artificial Sequence
  Description of Artificial Sequence: Synthetic oligonucleotide
uggcuuagaauacuuucacaa

SEQ ID NO: 27298 - RNA, 21 nt, Artificial Sequence
  Description of Artificial Sequence: Synthetic oligonucleotide
uuggcuuagaauacuuucaca

SEQ ID NO: 27299 - RNA, 21 nt, Artificial Sequence
  Description of Artificial Sequence: Synthetic oligonucleotide
cuuggcuuagaauacuuucac

SEQ ID NO: 27300 - RNA, 21 nt, Artificial Sequence
  Description of Artificial Sequence: Synthetic oligonucleotide
acuuggcuuagaauacuuuca

SEQ ID NO: 27301 - RNA, 21 nt, Artificial Sequence
  Description of Artificial Sequence: Synthetic oligonucleotide
aacuuggcuuagaauacuuuc

SEQ ID NO: 27302 - RNA, 21 nt, Artificial Sequence
  Description of Artificial Sequence: Synthetic oligonucleotide
aaacuuggcuuagaauacuuu

SEQ ID NO: 27303 - RNA, 21 nt, Artificial Sequence
  Description of Artificial Sequence: Synthetic oligonucleotide
aaaacuuggcuuagaauacuu

SEQ ID NO: 27304 - RNA, 21 nt, Artificial Sequence
  Description of Artificial Sequence: Synthetic oligonucleotide
uaaaacuuggcuuagaauacu

SEQ ID NO: 27305 - RNA, 21 nt, Artificial Sequence
  Description of Artificial Sequence: Synthetic oligonucleotide
uuaaaacuuggcuuagaauac

SEQ ID NO: 27306 - RNA, 21 nt, Artificial Sequence
  Description of Artificial Sequence: Synthetic oligonucleotide
uuuaaaacuuggcuuagaaua

SEQ ID NO: 27307 - RNA, 21 nt, Artificial Sequence
  Description of Artificial Sequence: Synthetic oligonucleotide
auuuaaaacuuggcuuagaau

SEQ ID NO: 27308 - RNA, 21 nt, Artificial Sequence
  Description of Artificial Sequence: Synthetic oligonucleotide
uauuuaaaacuuggcuuagaa

SEQ ID NO: 27309 - RNA, 21 nt, Artificial Sequence
  Description of Artificial Sequence: Synthetic oligonucleotide
auauuuaaaacuuggcuuaga

SEQ ID NO: 27310 - RNA, 21 nt, Artificial Sequence
  Description of Artificial Sequence: Synthetic oligonucleotide
aauauuuaaaacuuggcuuag

SEQ ID NO: 27311 - RNA, 21 nt, Artificial Sequence
  Description of Artificial Sequence: Synthetic oligonucleotide
uaauauuuaaaacuuggcuua

SEQ ID NO: 27312 - RNA, 21 nt, Artificial Sequence
  Description of Artificial Sequence: Synthetic oligonucleotide
auaauauuuaaaacuuggcuu

SEQ ID NO: 27313 - RNA, 21 nt, Artificial Sequence
  Description of Artificial Sequence: Synthetic oligonucleotide
gauaauauuuaaaacuuggcu

SEQ ID NO: 27314 - RNA, 21 nt, Artificial Sequence
  Description of Artificial Sequence: Synthetic oligonucleotide
agauaauauuuaaaacuuggc

SEQ ID NO: 27315 - RNA, 21 nt, Artificial Sequence
  Description of Artificial Sequence: Synthetic oligonucleotide
uagauaauauuuaaaacuugg

SEQ ID NO: 27316 - RNA, 21 nt, Artificial Sequence
  Description of Artificial Sequence: Synthetic oligonucleotide
uuagauaauauuuaaaacuug

SEQ ID NO: 27317 - RNA, 21 nt, Artificial Sequence
  Description of Artificial Sequence: Synthetic oligonucleotide
guuagauaauauuuaaaacuu

SEQ ID NO: 27318 - RNA, 21 nt, Artificial Sequence
  Description of Artificial Sequence: Synthetic oligonucleotide
uguuagauaauauuuaaaacu

SEQ ID NO: 27319 - RNA, 21 nt, Artificial Sequence
  Description of Artificial Sequence: Synthetic oligonucleotide
cuguuagauaauauuuaaaac

SEQ ID NO: 27320 - RNA, 21 nt, Artificial Sequence
  Description of Artificial Sequence: Synthetic oligonucleotide
ucuguuagauaauauuuaaaa

SEQ ID NO: 27321 - RNA, 21 nt, Artificial Sequence
  Description of Artificial Sequence: Synthetic oligonucleotide
gucuguuagauaauauuuaaa

SEQ ID NO: 27322 - RNA, 21 nt, Artificial Sequence
  Description of Artificial Sequence: Synthetic oligonucleotide
ugucuguuagauaauauuuaa

SEQ ID NO: 27323 - RNA, 21 nt, Artificial Sequence
  Description of Artificial Sequence: Synthetic oligonucleotide
uugucuguuagauaauauuua

SEQ ID NO: 27324 - RNA, 21 nt, Artificial Sequence
  Description of Artificial Sequence: Synthetic oligonucleotide
cuugucuguuagauaauauuu

SEQ ID NO: 27325 - RNA, 21 nt, Artificial Sequence
  Description of Artificial Sequence: Synthetic oligonucleotide
ucuugucuguuagauaauauu

SEQ ID NO: 27326 - RNA, 21 nt, Artificial Sequence
  Description of Artificial Sequence: Synthetic oligonucleotide
cucuugucuguuagauaauau

SEQ ID NO: 27327 - RNA, 21 nt, Artificial Sequence
  Description of Artificial Sequence: Synthetic oligonucleotide
acucuugucuguuagauaaua

SEQ ID NO: 27328 - RNA, 21 nt, Artificial Sequence
  Description of Artificial Sequence: Synthetic oligonucleotide
cacucuugucuguuagauaau

SEQ ID NO: 27329 - RNA, 21 nt, Artificial Sequence
  Description of Artificial Sequence: Synthetic oligonucleotide
ccacucuugucuguuagauaa

SEQ ID NO: 27330 - RNA, 21 nt, Artificial Sequence
  Description of Artificial Sequence: Synthetic oligonucleotide
accacucuugucuguuagaua

SEQ ID NO: 27331 - RNA, 21 nt, Artificial Sequence
  Description of Artificial Sequence: Synthetic oligonucleotide
uaccacucuugucuguuagau

SEQ ID NO: 27332 - RNA, 21 nt, Artificial Sequence
  Description of Artificial Sequence: Synthetic oligonucleotide
auaccacucuugucuguuaga

SEQ ID NO: 27333 - RNA, 21 nt, Artificial Sequence
  Description of Artificial Sequence: Synthetic oligonucleotide
uauaccacucuugucuguuag

SEQ ID NO: 27334 - RNA, 21 nt, Artificial Sequence
  Description of Artificial Sequence: Synthetic oligonucleotide
auauaccacucuugucuguua

SEQ ID NO: 27335 - RNA, 21 nt, Artificial Sequence
  Description of Artificial Sequence: Synthetic oligonucleotide
uauauaccacucuugucuguu

SEQ ID NO: 27336 - RNA, 21 nt, Artificial Sequence
  Description of Artificial Sequence: Synthetic oligonucleotide
guauauaccacucuugucugu

SEQ ID NO: 27337 - RNA, 21 nt, Artificial Sequence
  Description of Artificial Sequence: Synthetic oligonucleotide
uguauauaccacucuugucug

SEQ ID NO: 27338 - RNA, 21 nt, Artificial Sequence
  Description of Artificial Sequence: Synthetic oligonucleotide
uuguauauaccacucuugucu

SEQ ID NO: 27339 - RNA, 21 nt, Artificial Sequence
  Description of Artificial Sequence: Synthetic oligonucleotide
cuuguauauaccacucuuguc

SEQ ID NO: 27340 - RNA, 21 nt, Artificial Sequence
  Description of Artificial Sequence: Synthetic oligonucleotide
acuuguauauaccacucuugu

SEQ ID NO: 27341 - RNA, 21 nt, Artificial Sequence
  Description of Artificial Sequence: Synthetic oligonucleotide
uacuuguauauaccacucuug

SEQ ID NO: 27342 - RNA, 21 nt, Artificial Sequence
  Description of Artificial Sequence: Synthetic oligonucleotide
cuacuuguauauaccacucuu

SEQ ID NO: 27343 - RNA, 21 nt, Artificial Sequence
  Description of Artificial Sequence: Synthetic oligonucleotide
ucuacuuguauauaccacucu

SEQ ID NO: 27344 - RNA, 21 nt, Artificial Sequence
  Description of Artificial Sequence: Synthetic oligonucleotide
aucuacuuguauauaccacuc

SEQ ID NO: 27345 - RNA, 21 nt, Artificial Sequence
  Description of Artificial Sequence: Synthetic oligonucleotide
gaucuacuuguauauaccacu

SEQ ID NO: 27346 - RNA, 21 nt, Artificial Sequence
  Description of Artificial Sequence: Synthetic oligonucleotide
ggaucuacuuguauauaccac

SEQ ID NO: 27347 - RNA, 21 nt, Artificial Sequence
  Description of Artificial Sequence: Synthetic oligonucleotide
aggaucuacuuguauauacca

SEQ ID NO: 27348 - RNA, 21 nt, Artificial Sequence
  Description of Artificial Sequence: Synthetic oligonucleotide
caggaucuacuuguauauacc

SEQ ID NO: 27349 - RNA, 21 nt, Artificial Sequence
  Description of Artificial Sequence: Synthetic oligonucleotide
ucaggaucuacuuguauauac

SEQ ID NO: 27350 - RNA, 21 nt, Artificial Sequence
  Description of Artificial Sequence: Synthetic oligonucleotide
cucaggaucuacuuguauaua

SEQ ID NO: 27351 - RNA, 21 nt, Artificial Sequence
  Description of Artificial Sequence: Synthetic oligonucleotide
ucucaggaucuacuuguauau

SEQ ID NO: 27352 - RNA, 21 nt, Artificial Sequence
  Description of Artificial Sequence: Synthetic oligonucleotide
uucucaggaucuacuuguaua

SEQ ID NO: 27353 - RNA, 21 nt, Artificial Sequence
  Description of Artificial Sequence: Synthetic oligonucleotide
cuucucaggaucuacuuguau

SEQ ID NO: 27354 - RNA, 21 nt, Artificial Sequence
  Description of Artificial Sequence: Synthetic oligonucleotide
acuucucaggaucuacuugua

SEQ ID NO: 27355 - RNA, 21 nt, Artificial Sequence
  Description of Artificial Sequence: Synthetic oligonucleotide
uacuucucaggaucuacuugu

SEQ ID NO: 27356 - RNA, 21 nt, Artificial Sequence
  Description of Artificial Sequence: Synthetic oligonucleotide
guacuucucaggaucuacuug

SEQ ID NO: 27357 - RNA, 21 nt, Artificial Sequence
  Description of Artificial Sequence: Synthetic oligonucleotide
gguacuucucaggaucuacuu

SEQ ID NO: 27358 - RNA, 21 nt, Artificial Sequence
  Description of Artificial Sequence: Synthetic oligonucleotide
agguacuucucaggaucuacu

SEQ ID NO: 27359 - RNA, 21 nt, Artificial Sequence
  Description of Artificial Sequence: Synthetic oligonucleotide
aagguacuucucaggaucuac

SEQ ID NO: 27360 - RNA, 21 nt, Artificial Sequence
  Description of Artificial Sequence: Synthetic oligonucleotide
aaagguacuucucaggaucua

SEQ ID NO: 27361 - RNA, 21 nt, Artificial Sequence
  Description of Artificial Sequence: Synthetic oligonucleotide
caaagguacuucucaggaucu

SEQ ID NO: 27362 - RNA, 21 nt, Artificial Sequence
  Description of Artificial Sequence: Synthetic oligonucleotide
acaaagguacuucucaggauc

SEQ ID NO: 27363 - RNA, 21 nt, Artificial Sequence
  Description of Artificial Sequence: Synthetic oligonucleotide
aacaaagguacuucucaggau

SEQ ID NO: 27364 - RNA, 21 nt, Artificial Sequence
  Description of Artificial Sequence: Synthetic oligonucleotide
uaacaaagguacuucucagga

SEQ ID NO: 27365 - RNA, 21 nt, Artificial Sequence
  Description of Artificial Sequence: Synthetic oligonucleotide
guaacaaagguacuucucagg

SEQ ID NO: 27366 - RNA, 21 nt, Artificial Sequence
  Description of Artificial Sequence: Synthetic oligonucleotide
uguaacaaagguacuucucag

SEQ ID NO: 27367 - RNA, 21 nt, Artificial Sequence
  Description of Artificial Sequence: Synthetic oligonucleotide
cuguaacaaagguacuucuca

SEQ ID NO: 27368 - RNA, 21 nt, Artificial Sequence
  Description of Artificial Sequence: Synthetic oligonucleotide
gcuguaacaaagguacuucuc

SEQ ID NO: 27369 - RNA, 21 nt, Artificial Sequence
  Description of Artificial Sequence: Synthetic oligonucleotide
agcuguaacaaagguacuucu

SEQ ID NO: 27370 - RNA, 21 nt, Artificial Sequence
  Description of Artificial Sequence: Synthetic oligonucleotide
uagcuguaacaaagguacuuc

SEQ ID NO: 27371 - RNA, 21 nt, Artificial Sequence
  Description of Artificial Sequence: Synthetic oligonucleotide
guagcuguaacaaagguacuu

SEQ ID NO: 27372 - RNA, 21 nt, Artificial Sequence
  Description of Artificial Sequence: Synthetic oligonucleotide
aguagcuguaacaaagguacu

SEQ ID NO: 27373 - RNA, 21 nt, Artificial Sequence
  Description of Artificial Sequence: Synthetic oligonucleotide
uaguagcuguaacaaagguac

SEQ ID NO: 27374 - RNA, 21 nt, Artificial Sequence
  Description of Artificial Sequence: Synthetic oligonucleotide
auaguagcuguaacaaaggua

SEQ ID NO: 27375 - RNA, 21 nt, Artificial Sequence
  Description of Artificial Sequence: Synthetic oligonucleotide
uauaguagcuguaacaaaggu

SEQ ID NO: 27376 - RNA, 21 nt, Artificial Sequence
  Description of Artificial Sequence: Synthetic oligonucleotide
uuauaguagcuguaacaaagg

SEQ ID NO: 27377 - RNA, 21 nt, Artificial Sequence
  Description of Artificial Sequence: Synthetic oligonucleotide
uuuauaguagcuguaacaaag

SEQ ID NO: 27378 - RNA, 21 nt, Artificial Sequence
  Description of Artificial Sequence: Synthetic oligonucleotide
auuuauaguagcuguaacaaa

SEQ ID NO: 27379 - RNA, 21 nt, Artificial Sequence
  Description of Artificial Sequence: Synthetic oligonucleotide
uauuuauaguagcuguaacaa

SEQ ID NO: 27380 - RNA, 21 nt, Artificial Sequence
  Description of Artificial Sequence: Synthetic oligonucleotide
auauuuauaguagcuguaaca

SEQ ID NO: 27381 - RNA, 21 nt, Artificial Sequence
  Description of Artificial Sequence: Synthetic oligonucleotide
uauauuuauaguagcuguaac

SEQ ID NO: 27382 - RNA, 21 nt, Artificial Sequence
  Description of Artificial Sequence: Synthetic oligonucleotide
guauauuuauaguagcuguaa

SEQ ID NO: 27383 - RNA, 21 nt, Artificial Sequence
  Description of Artificial Sequence: Synthetic oligonucleotide
uguauauuuauaguagcugua

SEQ ID NO: 27384 - RNA, 21 nt, Artificial Sequence
  Description of Artificial Sequence: Synthetic oligonucleotide
auguauauuuauaguagcugu

SEQ ID NO: 27385 - RNA, 21 nt, Artificial Sequence
  Description of Artificial Sequence: Synthetic oligonucleotide
uauguauauuuauaguagcug

SEQ ID NO: 27386 - RNA, 21 nt, Artificial Sequence
  Description of Artificial Sequence: Synthetic oligonucleotide
auauguauauuuauaguagcu

SEQ ID NO: 27387 - RNA, 21 nt, Artificial Sequence
  Description of Artificial Sequence: Synthetic oligonucleotide
uauauguauauuuauaguagc

SEQ ID NO: 27388 - RNA, 21 nt, Artificial Sequence
  Description of Artificial Sequence: Synthetic oligonucleotide
uuauauguauauuuauaguag

SEQ ID NO: 27389 - RNA, 21 nt, Artificial Sequence
  Description of Artificial Sequence: Synthetic oligonucleotide
uuuauauguauauuuauagua

SEQ ID NO: 27390 - RNA, 21 nt, Artificial Sequence
  Description of Artificial Sequence: Synthetic oligonucleotide
auuuauauguauauuuauagu

SEQ ID NO: 27391 - RNA, 21 nt, Artificial Sequence
  Description of Artificial Sequence: Synthetic oligonucleotide
aauuuauauguauauuuauag

SEQ ID NO: 27392 - RNA, 21 nt, Artificial Sequence
  Description of Artificial Sequence: Synthetic oligonucleotide
uaauuuauauguauauuuaua

SEQ ID NO: 27393 - RNA, 21 nt, Artificial Sequence
  Description of Artificial Sequence: Synthetic oligonucleotide
auaauuuauauguauauuuau

SEQ ID NO: 27394 - RNA, 21 nt, Artificial Sequence
  Description of Artificial Sequence: Synthetic oligonucleotide
uauaauuuauauguauauuua

SEQ ID NO: 27395 - RNA, 21 nt, Artificial Sequence
  Description of Artificial Sequence: Synthetic oligonucleotide
cuauaauuuauauguauauuu

SEQ ID NO: 27396 - RNA, 21 nt, Artificial Sequence
  Description of Artificial Sequence: Synthetic oligonucleotide
ucuauaauuuauauguauauu

SEQ ID NO: 27397 - RNA, 21 nt, Artificial Sequence
  Description of Artificial Sequence: Synthetic oligonucleotide
uucuauaauuuauauguauau

SEQ ID NO: 27398 - RNA, 21 nt, Artificial Sequence
  Description of Artificial Sequence: Synthetic oligonucleotide
auucuauaauuuauauguaua

SEQ ID NO: 27399 - RNA, 21 nt, Artificial Sequence
  Description of Artificial Sequence: Synthetic oligonucleotide
gauucuauaauuuauauguau

SEQ ID NO: 27400 - RNA, 21 nt, Artificial Sequence
  Description of Artificial Sequence: Synthetic oligonucleotide
agauucuauaauuuauaugua

SEQ ID NO: 27401 - RNA, 21 nt, Artificial Sequence
  Description of Artificial Sequence: Synthetic oligonucleotide
uagauucuauaauuuauaugu

SEQ ID NO: 27402 - RNA, 21 nt, Artificial Sequence
  Description of Artificial Sequence: Synthetic oligonucleotide
guagauucuauaauuuauaug

SEQ ID NO: 27403 - RNA, 21 nt, Artificial Sequence
  Description of Artificial Sequence: Synthetic oligonucleotide
aguagauucuauaauuuauau

SEQ ID NO: 27404 - RNA, 21 nt, Artificial Sequence
  Description of Artificial Sequence: Synthetic oligonucleotide
aaguagauucuauaauuuaua

SEQ ID NO: 27405 - RNA, 21 nt, Artificial Sequence
  Description of Artificial Sequence: Synthetic oligonucleotide
aaaguagauucuauaauuuau

SEQ ID NO: 27406 - RNA, 21 nt, Artificial Sequence
  Description of Artificial Sequence: Synthetic oligonucleotide
uaaaguagauucuauaauuua

SEQ ID NO: 27407 - RNA, 21 nt, Artificial Sequence
  Description of Artificial Sequence: Synthetic oligonucleotide
uuaaaguagauucuauaauuu

SEQ ID NO: 27408 - RNA, 21 nt, Artificial Sequence
  Description of Artificial Sequence: Synthetic oligonucleotide
auuaaaguagauucuauaauu

SEQ ID NO: 27409 - RNA, 21 nt, Artificial Sequence
  Description of Artificial Sequence: Synthetic oligonucleotide
aauuaaaguagauucuauaau

SEQ ID NO: 27410 - RNA, 21 nt, Artificial Sequence
  Description of Artificial Sequence: Synthetic oligonucleotide
aaauuaaaguagauucuauaa

SEQ ID NO: 27411 - RNA, 21 nt, Artificial Sequence
  Description of Artificial Sequence: Synthetic oligonucleotide
uaaauuaaaguagauucuaua

SEQ ID NO: 27412 - RNA, 21 nt, Artificial Sequence
  Description of Artificial Sequence: Synthetic oligonucleotide
auaaauuaaaguagauucuau

SEQ ID NO: 27413 - RNA, 21 nt, Artificial Sequence
  Description of Artificial Sequence: Synthetic oligonucleotide
aauaaauuaaaguagauucua

SEQ ID NO: 27414 - RNA, 21 nt, Artificial Sequence
  Description of Artificial Sequence: Synthetic oligonucleotide
aaauaaauuaaaguagauucu

SEQ ID NO: 27415 - RNA, 21 nt, Artificial Sequence
  Description of Artificial Sequence: Synthetic oligonucleotide
aaaauaaauuaaaguagauuc

SEQ ID NO: 27416 - RNA, 21 nt, Artificial Sequence
  Description of Artificial Sequence: Synthetic oligonucleotide
caaaauaaauuaaaguagauu

SEQ ID NO: 27417 - RNA, 21 nt, Artificial Sequence
  Description of Artificial Sequence: Synthetic oligonucleotide
acaaaauaaauuaaaguagau

SEQ ID NO: 27418 - RNA, 21 nt, Artificial Sequence
  Description of Artificial Sequence: Synthetic oligonucleotide
cacaaaauaaauuaaaguaga

SEQ ID NO: 27419 - RNA, 21 nt, Artificial Sequence
  Description of Artificial Sequence: Synthetic oligonucleotide
ucacaaaauaaauuaaaguag

SEQ ID NO: 27420 - RNA, 21 nt, Artificial Sequence
  Description of Artificial Sequence: Synthetic oligonucleotide
uucacaaaauaaauuaaagua

SEQ ID NO: 27421 - RNA, 21 nt, Artificial Sequence
  Description of Artificial Sequence: Synthetic oligonucleotide
guucacaaaauaaauuaaagu

SEQ ID NO: 27422 - RNA, 21 nt, Artificial Sequence
  Description of Artificial Sequence: Synthetic oligonucleotide
uguucacaaaauaaauuaaag

SEQ ID NO: 27423 - RNA, 21 nt, Artificial Sequence
  Description of Artificial Sequence: Synthetic oligonucleotide
guguucacaaaauaaauuaaa

SEQ ID NO: 27424 - RNA, 21 nt, Artificial Sequence
  Description of Artificial Sequence: Synthetic oligonucleotide
aguguucacaaaauaaauuaa

SEQ ID NO: 27425 - RNA, 21 nt, Artificial Sequence
  Description of Artificial Sequence: Synthetic oligonucleotide
aaguguucacaaaauaaauua

SEQ ID NO: 27426 - RNA, 21 nt, Artificial Sequence
  Description of Artificial Sequence: Synthetic oligonucleotide
aaaguguucacaaaauaaauu

SEQ ID NO: 27427 - RNA, 21 nt, Artificial Sequence
  Description of Artificial Sequence: Synthetic oligonucleotide
aaaaguguucacaaaauaaau

SEQ ID NO: 27428 - RNA, 21 nt, Artificial Sequence
  Description of Artificial Sequence: Synthetic oligonucleotide
caaaaguguucacaaaauaaa

SEQ ID NO: 27429 - RNA, 21 nt, Artificial Sequence
  Description of Artificial Sequence: Synthetic oligonucleotide
ucaaaaguguucacaaaauaa

SEQ ID NO: 27430 - RNA, 21 nt, Artificial Sequence
  Description of Artificial Sequence: Synthetic oligonucleotide
uucaaaaguguucacaaaaua

SEQ ID NO: 27431 - RNA, 21 nt, Artificial Sequence
  Description of Artificial Sequence: Synthetic oligonucleotide
uuucaaaaguguucacaaaau

SEQ ID NO: 27432 - RNA, 21 nt, Artificial Sequence
  Description of Artificial Sequence: Synthetic oligonucleotide
uuuucaaaaguguucacaaaa

SEQ ID NO: 27433 - RNA, 21 nt, Artificial Sequence
  Description of Artificial Sequence: Synthetic oligonucleotide
auuuucaaaaguguucacaaa

SEQ ID NO: 27434 - RNA, 21 nt, Artificial Sequence
  Description of Artificial Sequence: Synthetic oligonucleotide
cauuuucaaaaguguucacaa

SEQ ID NO: 27435 - RNA, 21 nt, Artificial Sequence
  Description of Artificial Sequence: Synthetic oligonucleotide
acauuuucaaaaguguucaca

SEQ ID NO: 27436 - RNA, 21 nt, Artificial Sequence
  Description of Artificial Sequence: Synthetic oligonucleotide
uacauuuucaaaaguguucac

SEQ ID NO: 27437 - RNA, 21 nt, Artificial Sequence
  Description of Artificial Sequence: Synthetic oligonucleotide
guacauuuucaaaaguguuca

SEQ ID NO: 27438 - RNA, 21 nt, Artificial Sequence
  Description of Artificial Sequence: Synthetic oligonucleotide
uguacauuuucaaaaguguuc

SEQ ID NO: 27439 - RNA, 21 nt, Artificial Sequence
  Description of Artificial Sequence: Synthetic oligonucleotide
auguacauuuucaaaaguguu

SEQ ID NO: 27440 - RNA, 21 nt, Artificial Sequence
  Description of Artificial Sequence: Synthetic oligonucleotide
cauguacauuuucaaaagugu

SEQ ID NO: 27441 - RNA, 21 nt, Artificial Sequence
  Description of Artificial Sequence: Synthetic oligonucleotide
acauguacauuuucaaaagug

SEQ ID NO: 27442 - RNA, 21 nt, Artificial Sequence
  Description of Artificial Sequence: Synthetic oligonucleotide
aacauguacauuuucaaaagu

SEQ ID NO: 27443 - RNA, 21 nt, Artificial Sequence
  Description of Artificial Sequence: Synthetic oligonucleotide
gaacauguacauuuucaaaag

SEQ ID NO: 27444 - RNA, 21 nt, Artificial Sequence
  Description of Artificial Sequence: Synthetic oligonucleotide
ggaacauguacauuuucaaaa

SEQ ID NO: 27445 - RNA, 21 nt, Artificial Sequence
  Description of Artificial Sequence: Synthetic oligonucleotide
aggaacauguacauuuucaaa

SEQ ID NO: 27446 - RNA, 21 nt, Artificial Sequence
  Description of Artificial Sequence: Synthetic oligonucleotide
aaggaacauguacauuuucaa

SEQ ID NO: 27447 - RNA, 21 nt, Artificial Sequence
  Description of Artificial Sequence: Synthetic oligonucleotide
aaaggaacauguacauuuuca

SEQ ID NO: 27448 - RNA, 21 nt, Artificial Sequence
  Description of Artificial Sequence: Synthetic oligonucleotide
caaaggaacauguacauuuuc

SEQ ID NO: 27449 - RNA, 21 nt, Artificial Sequence
  Description of Artificial Sequence: Synthetic oligonucleotide
acaaaggaacauguacauuuu

SEQ ID NO: 27450 - RNA, 21 nt, Artificial Sequence
  Description of Artificial Sequence: Synthetic oligonucleotide
uacaaaggaacauguacauuu

SEQ ID NO: 27451 - RNA, 21 nt, Artificial Sequence
  Description of Artificial Sequence: Synthetic oligonucleotide
uuacaaaggaacauguacauu

SEQ ID NO: 27452 - RNA, 21 nt, Artificial Sequence
  Description of Artificial Sequence: Synthetic oligonucleotide
auuacaaaggaacauguacau

SEQ ID NO: 27453 - RNA, 21 nt, Artificial Sequence
  Description of Artificial Sequence: Synthetic oligonucleotide
aauuacaaaggaacauguaca

SEQ ID NO: 27454 - RNA, 21 nt, Artificial Sequence
  Description of Artificial Sequence: Synthetic oligonucleotide
caauuacaaaggaacauguac

SEQ ID NO: 27455 - RNA, 21 nt, Artificial Sequence
  Description of Artificial Sequence: Synthetic oligonucleotide
ucaauuacaaaggaacaugua

SEQ ID NO: 27456 - RNA, 21 nt, Artificial Sequence
  Description of Artificial Sequence: Synthetic oligonucleotide
gucaauuacaaaggaacaugu

SEQ ID NO: 27457 - RNA, 21 nt, Artificial Sequence
  Description of Artificial Sequence: Synthetic oligonucleotide
ugucaauuacaaaggaacaug

SEQ ID NO: 27458 - RNA, 21 nt, Artificial Sequence
  Description of Artificial Sequence: Synthetic oligonucleotide
gugucaauuacaaaggaacau

SEQ ID NO: 27459 - RNA, 21 nt, Artificial Sequence
  Description of Artificial Sequence: Synthetic oligonucleotide
agugucaauuacaaaggaaca

SEQ ID NO: 27460 - RNA, 21 nt, Artificial Sequence
  Description of Artificial Sequence: Synthetic oligonucleotide
uagugucaauuacaaaggaac

SEQ ID NO: 27461 - RNA, 21 nt, Artificial Sequence
  Description of Artificial Sequence: Synthetic oligonucleotide
auagugucaauuacaaaggaa

SEQ ID NO: 27462 - RNA, 21 nt, Artificial Sequence
  Description of Artificial Sequence: Synthetic oligonucleotide
uauagugucaauuacaaagga

SEQ ID NO: 27463 - RNA, 21 nt, Artificial Sequence
  Description of Artificial Sequence: Synthetic oligonucleotide
auauagugucaauuacaaagg

SEQ ID NO: 27464 - RNA, 21 nt, Artificial Sequence
  Description of Artificial Sequence: Synthetic oligonucleotide
uauauagugucaauuacaaag

SEQ ID NO: 27465 - RNA, 21 nt, Artificial Sequence
  Description of Artificial Sequence: Synthetic oligonucleotide
auauauagugucaauuacaaa

SEQ ID NO: 27466 - RNA, 21 nt, Artificial Sequence
  Description of Artificial Sequence: Synthetic oligonucleotide
aauauauagugucaauuacaa

SEQ ID NO: 27467 - RNA, 21 nt, Artificial Sequence
  Description of Artificial Sequence: Synthetic oligonucleotide
aaauauauagugucaauuaca

SEQ ID NO: 27468 - RNA, 21 nt, Artificial Sequence
  Description of Artificial Sequence: Synthetic oligonucleotide
gaaauauauagugucaauuac

SEQ ID NO: 27469 - RNA, 21 nt, Artificial Sequence
  Description of Artificial Sequence: Synthetic oligonucleotide
agaaauauauagugucaauua

SEQ ID NO: 27470 - RNA, 21 nt, Artificial Sequence
  Description of Artificial Sequence: Synthetic oligonucleotide
aagaaauauauagugucaauu

SEQ ID NO: 27471 - RNA, 21 nt, Artificial Sequence
  Description of Artificial Sequence: Synthetic oligonucleotide
uaagaaauauauagugucaau

SEQ ID NO: 27472 - RNA, 21 nt, Artificial Sequence
  Description of Artificial Sequence: Synthetic oligonucleotide
uuaagaaauauauagugucaa

SEQ ID NO: 27473 - RNA, 21 nt, Artificial Sequence
  Description of Artificial Sequence: Synthetic oligonucleotide
auuaagaaauauauaguguca

SEQ ID NO: 27474 - RNA, 21 nt, Artificial Sequence
  Description of Artificial Sequence: Synthetic oligonucleotide
uauuaagaaauauauaguguc

SEQ ID NO: 27475 - RNA, 21 nt, Artificial Sequence
  Description of Artificial Sequence: Synthetic oligonucleotide
uuauuaagaaauauauagugu

SEQ ID NO: 27476 - RNA, 21 nt, Artificial Sequence
  Description of Artificial Sequence: Synthetic oligonucleotide
uuuauuaagaaauauauagug

SEQ ID NO: 27477 - RNA, 21 nt, Artificial Sequence
  Description of Artificial Sequence: Synthetic oligonucleotide
uuuuauuaagaaauauauagu

SEQ ID NO: 27478 - RNA, 21 nt, Artificial Sequence
  Description of Artificial Sequence: Synthetic oligonucleotide
auuuuauuaagaaauauauag

SEQ ID NO: 27479 - RNA, 21 nt, Artificial Sequence
  Description of Artificial Sequence: Synthetic oligonucleotide
uauuuuauuaagaaauauaua

SEQ ID NO: 27480 - RNA, 21 nt, Artificial Sequence
  Description of Artificial Sequence: Synthetic oligonucleotide
uuauuuuauuaagaaauauau

SEQ ID NO: 27481 - RNA, 21 nt, Artificial Sequence
  Description of Artificial Sequence: Synthetic oligonucleotide
auuauuuuauuaagaaauaua

SEQ ID NO: 27482 - RNA, 21 nt, Artificial Sequence
  Description of Artificial Sequence: Synthetic oligonucleotide
aauuauuuuauuaagaaauau

SEQ ID NO: 27483 - RNA, 21 nt, Artificial Sequence
  Description of Artificial Sequence: Synthetic oligonucleotide
gaauuauuuuauuaagaaaua

SEQ ID NO: 27484 - RNA, 21 nt, Artificial Sequence
  Description of Artificial Sequence: Synthetic oligonucleotide
agaauuauuuuauuaagaaau

SEQ ID NO: 27485 - RNA, 21 nt, Artificial Sequence
  Description of Artificial Sequence: Synthetic oligonucleotide
gagaauuauuuuauuaagaaa

SEQ ID NO: 27486 - RNA, 21 nt, Artificial Sequence
  Description of Artificial Sequence: Synthetic oligonucleotide
ugagaauuauuuuauuaagaa

SEQ ID NO: 27487 - RNA, 21 nt, Artificial Sequence
  Description of Artificial Sequence: Synthetic oligonucleotide
uugagaauuauuuuauuaaga

SEQ ID NO: 27488 - RNA, 21 nt, Artificial Sequence
  Description of Artificial Sequence: Synthetic oligonucleotide
uuugagaauuauuuuauuaag

SEQ ID NO: 27489 - RNA, 21 nt, Artificial Sequence
  Description of Artificial Sequence: Synthetic oligonucleotide
auuugagaauuauuuuauuaa

SEQ ID NO: 27490 - RNA, 21 nt, Artificial Sequence
  Description of Artificial Sequence: Synthetic oligonucleotide
aauuugagaauuauuuuauua

SEQ ID NO: 27491 - RNA, 21 nt, Artificial Sequence
  Description of Artificial Sequence: Synthetic oligonucleotide
aaauuugagaauuauuuuauu

SEQ ID NO: 27492 - RNA, 21 nt, Artificial Sequence
  Description of Artificial Sequence: Synthetic oligonucleotide
caaauuugagaauuauuuuau

SEQ ID NO: 27493 - RNA, 21 nt, Artificial Sequence
  Description of Artificial Sequence: Synthetic oligonucleotide
acaaauuugagaauuauuuua

SEQ ID NO: 27494 - RNA, 21 nt, Artificial Sequence
  Description of Artificial Sequence: Synthetic oligonucleotide
aacaaauuugagaauuauuuu

SEQ ID NO: 27495 - RNA, 21 nt, Artificial Sequence
  Description of Artificial Sequence: Synthetic oligonucleotide
aaacaaauuugagaauuauuu

SEQ ID NO: 27496 - RNA, 21 nt, Artificial Sequence
  Description of Artificial Sequence: Synthetic oligonucleotide
gaaacaaauuugagaauuauu

SEQ ID NO: 27497 - RNA, 21 nt, Artificial Sequence
  Description of Artificial Sequence: Synthetic oligonucleotide
agaaacaaauuugagaauuau

SEQ ID NO: 27498 - RNA, 21 nt, Artificial Sequence
  Description of Artificial Sequence: Synthetic oligonucleotide
aagaaacaaauuugagaauua

SEQ ID NO: 27499 - RNA, 21 nt, Artificial Sequence
  Description of Artificial Sequence: Synthetic oligonucleotide
uaagaaacaaauuugagaauu

SEQ ID NO: 27500 - RNA, 21 nt, Artificial Sequence
  Description of Artificial Sequence: Synthetic oligonucleotide
auaagaaacaaauuugagaau

SEQ ID NO: 27501 - RNA, 21 nt, Artificial Sequence
  Description of Artificial Sequence: Synthetic oligonucleotide
cauaagaaacaaauuugagaa

SEQ ID NO: 27502 - RNA, 21 nt, Artificial Sequence
  Description of Artificial Sequence: Synthetic oligonucleotide
ucauaagaaacaaauuugaga

SEQ ID NO: 27503 - RNA, 21 nt, Artificial Sequence
  Description of Artificial Sequence: Synthetic oligonucleotide
uucauaagaaacaaauuugag

SEQ ID NO: 27504 - RNA, 21 nt, Artificial Sequence
  Description of Artificial Sequence: Synthetic oligonucleotide
auucauaagaaacaaauuuga

SEQ ID NO: 27505 - RNA, 21 nt, Artificial Sequence
  Description of Artificial Sequence: Synthetic oligonucleotide
gauucauaagaaacaaauuug

SEQ ID NO: 27506 - RNA, 21 nt, Artificial Sequence
  Description of Artificial Sequence: Synthetic oligonucleotide
ugauucauaagaaacaaauuu

SEQ ID NO: 27507 - RNA, 21 nt, Artificial Sequence
  Description of Artificial Sequence: Synthetic oligonucleotide
augauucauaagaaacaaauu

SEQ ID NO: 27508 - RNA, 21 nt, Artificial Sequence
  Description of Artificial Sequence: Synthetic oligonucleotide
gaugauucauaagaaacaaau

SEQ ID NO: 27509 - RNA, 21 nt, Artificial Sequence
  Description of Artificial Sequence: Synthetic oligonucleotide
agaugauucauaagaaacaaa

SEQ ID NO: 27510 - RNA, 21 nt, Artificial Sequence
  Description of Artificial Sequence: Synthetic oligonucleotide
gagaugauucauaagaaacaa

SEQ ID NO: 27511 - RNA, 21 nt, Artificial Sequence
  Description of Artificial Sequence: Synthetic oligonucleotide
agagaugauucauaagaaaca

SEQ ID NO: 27512 - RNA, 21 nt, Artificial Sequence
  Description of Artificial Sequence: Synthetic oligonucleotide
gagagaugauucauaagaaac

SEQ ID NO: 27513 - RNA, 21 nt, Artificial Sequence
  Description of Artificial Sequence: Synthetic oligonucleotide
ugagagaugauucauaagaaa

SEQ ID NO: 27514 - RNA, 21 nt, Artificial Sequence
  Description of Artificial Sequence: Synthetic oligonucleotide
uugagagaugauucauaagaa

SEQ ID NO: 27515 - RNA, 21 nt, Artificial Sequence
  Description of Artificial Sequence: Synthetic oligonucleotide
uuugagagaugauucauaaga

SEQ ID NO: 27516 - RNA, 21 nt, Artificial Sequence
  Description of Artificial Sequence: Synthetic oligonucleotide
auuugagagaugauucauaag

SEQ ID NO: 27517 - RNA, 21 nt, Artificial Sequence
  Description of Artificial Sequence: Synthetic oligonucleotide
gauuugagagaugauucauaa

SEQ ID NO: 27518 - RNA, 21 nt, Artificial Sequence
  Description of Artificial Sequence: Synthetic oligonucleotide
agauuugagagaugauucaua

SEQ ID NO: 27519 - RNA, 21 nt, Artificial Sequence
  Description of Artificial Sequence: Synthetic oligonucleotide
uagauuugagagaugauucau

SEQ ID NO: 27520 - RNA, 21 nt, Artificial Sequence
  Description of Artificial Sequence: Synthetic oligonucleotide
cuagauuugagagaugauuca

SEQ ID NO: 27521 - RNA, 21 nt, Artificial Sequence
  Description of Artificial Sequence: Synthetic oligonucleotide
acuagauuugagagaugauuc

SEQ ID NO: 27522 - RNA, 21 nt, Artificial Sequence
  Description of Artificial Sequence: Synthetic oligonucleotide
aacuagauuugagagaugauu

SEQ ID NO: 27523 - RNA, 21 nt, Artificial Sequence
  Description of Artificial Sequence: Synthetic oligonucleotide
uaacuagauuugagagaugau

SEQ ID NO: 27524 - RNA, 21 nt, Artificial Sequence
  Description of Artificial Sequence: Synthetic oligonucleotide
cuaacuagauuugagagauga

SEQ ID NO: 27525 - RNA, 21 nt, Artificial Sequence
  Description of Artificial Sequence: Synthetic oligonucleotide
ucuaacuagauuugagagaug

SEQ ID NO: 27526 - RNA, 21 nt, Artificial Sequence
  Description of Artificial Sequence: Synthetic oligonucleotide
gucuaacuagauuugagagau

SEQ ID NO: 27527 - RNA, 21 nt, Artificial Sequence
  Description of Artificial Sequence: Synthetic oligonucleotide
ugucuaacuagauuugagaga

SEQ ID NO: 27528 - RNA, 21 nt, Artificial Sequence
  Description of Artificial Sequence: Synthetic oligonucleotide
uugucuaacuagauuugagag

SEQ ID NO: 27529 - RNA, 21 nt, Artificial Sequence
  Description of Artificial Sequence: Synthetic oligonucleotide
auugucuaacuagauuugaga

SEQ ID NO: 27530 - RNA, 21 nt, Artificial Sequence
  Description of Artificial Sequence: Synthetic oligonucleotide
aauugucuaacuagauuugag

SEQ ID NO: 27531 - RNA, 21 nt, Artificial Sequence
  Description of Artificial Sequence: Synthetic oligonucleotide
aaauugucuaacuagauuuga

SEQ ID NO: 27532 - RNA, 21 nt, Artificial Sequence
  Description of Artificial Sequence: Synthetic oligonucleotide
caaauugucuaacuagauuug

SEQ ID NO: 27533 - RNA, 21 nt, Artificial Sequence
  Description of Artificial Sequence: Synthetic oligonucleotide
gcaaauugucuaacuagauuu

SEQ ID NO: 27534 - RNA, 21 nt, Artificial Sequence
  Description of Artificial Sequence: Synthetic oligonucleotide
ugcaaauugucuaacuagauu

SEQ ID NO: 27535 - RNA, 21 nt, Artificial Sequence
  Description of Artificial Sequence: Synthetic oligonucleotide
gugcaaauugucuaacuagau

SEQ ID NO: 27536 - RNA, 21 nt, Artificial Sequence
  Description of Artificial Sequence: Synthetic oligonucleotide
ugugcaaauugucuaacuaga

SEQ ID NO: 27537 - RNA, 21 nt, Artificial Sequence
  Description of Artificial Sequence: Synthetic oligonucleotide
gugugcaaauugucuaacuag

SEQ ID NO: 27538 - RNA, 21 nt, Artificial Sequence
  Description of Artificial Sequence: Synthetic oligonucleotide
ugugugcaaauugucuaacua

SEQ ID NO: 27539 - RNA, 21 nt, Artificial Sequence
  Description of Artificial Sequence: Synthetic oligonucleotide
augugugcaaauugucuaacu

SEQ ID NO: 27540 - RNA, 21 nt, Artificial Sequence
  Description of Artificial Sequence: Synthetic oligonucleotide
uaugugugcaaauugucuaac

SEQ ID NO: 27541 - RNA, 21 nt, Artificial Sequence
  Description of Artificial Sequence: Synthetic oligonucleotide
guaugugugcaaauugucuaa

SEQ ID NO: 27542 - RNA, 21 nt, Artificial Sequence
  Description of Artificial Sequence: Synthetic oligonucleotide
aguaugugugcaaauugucua

SEQ ID NO: 27543 - RNA, 21 nt, Artificial Sequence
  Description of Artificial Sequence: Synthetic oligonucleotide
aaguaugugugcaaauugucu

SEQ ID NO: 27544 - RNA, 21 nt, Artificial Sequence
  Description of Artificial Sequence: Synthetic oligonucleotide
aaaguaugugugcaaauuguc

SEQ ID NO: 27545 - RNA, 21 nt, Artificial Sequence
  Description of Artificial Sequence: Synthetic oligonucleotide
aaaaguaugugugcaaauugu

SEQ ID NO: 27546 - RNA, 21 nt, Artificial Sequence
  Description of Artificial Sequence: Synthetic oligonucleotide
gaaaaguaugugugcaaauug

SEQ ID NO: 27547 - RNA, 21 nt, Artificial Sequence
  Description of Artificial Sequence: Synthetic oligonucleotide
agaaaaguaugugugcaaauu

SEQ ID NO: 27548 - RNA, 21 nt, Artificial Sequence
  Description of Artificial Sequence: Synthetic oligonucleotide
uagaaaaguaugugugcaaau

SEQ ID NO: 27549 - RNA, 21 nt, Artificial Sequence
  Description of Artificial Sequence: Synthetic oligonucleotide
uuagaaaaguaugugugcaaa

SEQ ID NO: 27550 - RNA, 21 nt, Artificial Sequence
  Description of Artificial Sequence: Synthetic oligonucleotide
cuuagaaaaguaugugugcaa

SEQ ID NO: 27551 - RNA, 21 nt, Artificial Sequence
  Description of Artificial Sequence: Synthetic oligonucleotide
ccuuagaaaaguaugugugca

SEQ ID NO: 27552 - RNA, 21 nt, Artificial Sequence
  Description of Artificial Sequence: Synthetic oligonucleotide
cccuuagaaaaguaugugugc

SEQ ID NO: 27553 - RNA, 21 nt, Artificial Sequence
  Description of Artificial Sequence: Synthetic oligonucleotide
ucccuuagaaaaguaugugug

SEQ ID NO: 27554 - RNA, 21 nt, Artificial Sequence
  Description of Artificial Sequence: Synthetic oligonucleotide
gucccuuagaaaaguaugugu

SEQ ID NO: 27555 - RNA, 21 nt, Artificial Sequence
  Description of Artificial Sequence: Synthetic oligonucleotide
ugucccuuagaaaaguaugug

SEQ ID NO: 27556 - RNA, 21 nt, Artificial Sequence
  Description of Artificial Sequence: Synthetic oligonucleotide
augucccuuagaaaaguaugu

SEQ ID NO: 27557 - RNA, 21 nt, Artificial Sequence
  Description of Artificial Sequence: Synthetic oligonucleotide
aaugucccuuagaaaaguaug

SEQ ID NO: 27558 - RNA, 21 nt, Artificial Sequence
  Description of Artificial Sequence: Synthetic oligonucleotide
uaaugucccuuagaaaaguau

SEQ ID NO: 27559 - RNA, 21 nt, Artificial Sequence
  Description of Artificial Sequence: Synthetic oligonucleotide
auaaugucccuuagaaaagua

SEQ ID NO: 27560 - RNA, 21 nt, Artificial Sequence
  Description of Artificial Sequence: Synthetic oligonucleotide
gauaaugucccuuagaaaagu

SEQ ID NO: 27561 - RNA, 21 nt, Artificial Sequence
  Description of Artificial Sequence: Synthetic oligonucleotide
agauaaugucccuuagaaaag

SEQ ID NO: 27562 - RNA, 21 nt, Artificial Sequence
  Description of Artificial Sequence: Synthetic oligonucleotide
aagauaaugucccuuagaaaa

SEQ ID NO: 27563 - RNA, 21 nt, Artificial Sequence
  Description of Artificial Sequence: Synthetic oligonucleotide
gaagauaaugucccuuagaaa

SEQ ID NO: 27564 - RNA, 21 nt, Artificial Sequence
  Description of Artificial Sequence: Synthetic oligonucleotide
ggaagauaaugucccuuagaa

SEQ ID NO: 27565 - RNA, 21 nt, Artificial Sequence
  Description of Artificial Sequence: Synthetic oligonucleotide
aggaagauaaugucccuuaga

SEQ ID NO: 27566 - RNA, 21 nt, Artificial Sequence
  Description of Artificial Sequence: Synthetic oligonucleotide
aaggaagauaaugucccuuag

SEQ ID NO: 27567 - RNA, 21 nt, Artificial Sequence
  Description of Artificial Sequence: Synthetic oligonucleotide
gaaggaagauaaugucccuua

SEQ ID NO: 27568 - RNA, 21 nt, Artificial Sequence
  Description of Artificial Sequence: Synthetic oligonucleotide
ugaaggaagauaaugucccuu

SEQ ID NO: 27569 - RNA, 21 nt, Artificial Sequence
  Description of Artificial Sequence: Synthetic oligonucleotide
cugaaggaagauaaugucccu

SEQ ID NO: 27570 - RNA, 21 nt, Artificial Sequence
  Description of Artificial Sequence: Synthetic oligonucleotide
ccugaaggaagauaauguccc

SEQ ID NO: 27571 - RNA, 21 nt, Artificial Sequence
  Description of Artificial Sequence: Synthetic oligonucleotide
accugaaggaagauaaugucc

SEQ ID NO: 27572 - RNA, 21 nt, Artificial Sequence
  Description of Artificial Sequence: Synthetic oligonucleotide
aaccugaaggaagauaauguc

SEQ ID NO: 27573 - RNA, 21 nt, Artificial Sequence
  Description of Artificial Sequence: Synthetic oligonucleotide
aaaccugaaggaagauaaugu

SEQ ID NO: 27574 - RNA, 21 nt, Artificial Sequence
  Description of Artificial Sequence: Synthetic oligonucleotide
aaaaccugaaggaagauaaug

SEQ ID NO: 27575 - RNA, 21 nt, Artificial Sequence
  Description of Artificial Sequence: Synthetic oligonucleotide
aaaaaccugaaggaagauaau

SEQ ID NO: 27576 - RNA, 21 nt, Artificial Sequence
  Description of Artificial Sequence: Synthetic oligonucleotide
uaaaaaccugaaggaagauaa

SEQ ID NO: 27577 - RNA, 21 nt, Artificial Sequence
  Description of Artificial Sequence: Synthetic oligonucleotide
guaaaaaccugaaggaagaua

SEQ ID NO: 27578 - RNA, 21 nt, Artificial Sequence
  Description of Artificial Sequence: Synthetic oligonucleotide
gguaaaaaccugaaggaagau

SEQ ID NO: 27579 - RNA, 21 nt, Artificial Sequence
  Description of Artificial Sequence: Synthetic oligonucleotide
agguaaaaaccugaaggaaga

SEQ ID NO: 27580 - RNA, 21 nt, Artificial Sequence
  Description of Artificial Sequence: Synthetic oligonucleotide
gagguaaaaaccugaaggaag

SEQ ID NO: 27581 - RNA, 21 nt, Artificial Sequence
  Description of Artificial Sequence: Synthetic oligonucleotide
ggagguaaaaaccugaaggaa

SEQ ID NO: 27582 - RNA, 21 nt, Artificial Sequence
  Description of Artificial Sequence: Synthetic oligonucleotide
uggagguaaaaaccugaagga

SEQ ID NO: 27583 - RNA, 21 nt, Artificial Sequence
  Description of Artificial Sequence: Synthetic oligonucleotide
guggagguaaaaaccugaagg

SEQ ID NO: 27584 - RNA, 21 nt, Artificial Sequence
  Description of Artificial Sequence: Synthetic oligonucleotide
aguggagguaaaaaccugaag

SEQ ID NO: 27585 - RNA, 21 nt, Artificial Sequence
  Description of Artificial Sequence: Synthetic oligonucleotide
gaguggagguaaaaaccugaa

SEQ ID NO: 27586 - RNA, 21 nt, Artificial Sequence
  Description of Artificial Sequence: Synthetic oligonucleotide
ugaguggagguaaaaaccuga

SEQ ID NO: 27587 - RNA, 21 nt, Artificial Sequence
  Description of Artificial Sequence: Synthetic oligonucleotide
augaguggagguaaaaaccug

SEQ ID NO: 27588 - RNA, 21 nt, Artificial Sequence
  Description of Artificial Sequence: Synthetic oligonucleotide
gaugaguggagguaaaaaccu

SEQ ID NO: 27589 - RNA, 21 nt, Artificial Sequence
  Description of Artificial Sequence: Synthetic oligonucleotide
ggaugaguggagguaaaaacc

SEQ ID NO: 27590 - RNA, 21 nt, Artificial Sequence
  Description of Artificial Sequence: Synthetic oligonucleotide
aggaugaguggagguaaaaac

SEQ ID NO: 27591 - RNA, 21 nt, Artificial Sequence
  Description of Artificial Sequence: Synthetic oligonucleotide
aaggaugaguggagguaaaaa

SEQ ID NO: 27592 - RNA, 21 nt, Artificial Sequence
  Description of Artificial Sequence: Synthetic oligonucleotide
uaaggaugaguggagguaaaa

SEQ ID NO: 27593 - RNA, 21 nt, Artificial Sequence
  Description of Artificial Sequence: Synthetic oligonucleotide
cuaaggaugaguggagguaaa

SEQ ID NO: 27594 - RNA, 21 nt, Artificial Sequence
  Description of Artificial Sequence: Synthetic oligonucleotide
ucuaaggaugaguggagguaa

SEQ ID NO: 27595 - RNA, 21 nt, Artificial Sequence
  Description of Artificial Sequence: Synthetic oligonucleotide
cucuaaggaugaguggaggua

SEQ ID NO: 27596 - RNA, 21 nt, Artificial Sequence
  Description of Artificial Sequence: Synthetic oligonucleotide
gcucuaaggaugaguggaggu

SEQ ID NO: 27597 - RNA, 21 nt, Artificial Sequence
  Description of Artificial Sequence: Synthetic oligonucleotide
ggcucuaaggaugaguggagg

SEQ ID NO: 27598 - RNA, 21 nt, Artificial Sequence
  Description of Artificial Sequence: Synthetic oligonucleotide
gggcucuaaggaugaguggag

SEQ ID NO: 27599 - RNA, 21 nt, Artificial Sequence
  Description of Artificial Sequence: Synthetic oligonucleotide
ugggcucuaaggaugagugga

SEQ ID NO: 27600 - RNA, 21 nt, Artificial Sequence
  Description of Artificial Sequence: Synthetic oligonucleotide
gugggcucuaaggaugagugg

SEQ ID NO: 27601 - RNA, 21 nt, Artificial Sequence
  Description of Artificial Sequence: Synthetic oligonucleotide
agugggcucuaaggaugagug

SEQ ID NO: 27602 - RNA, 21 nt, Artificial Sequence
  Description of Artificial Sequence: Synthetic oligonucleotide
cagugggcucuaaggaugagu

SEQ ID NO: 27603 - RNA, 21 nt, Artificial Sequence
  Description of Artificial Sequence: Synthetic oligonucleotide
ucagugggcucuaaggaugag

SEQ ID NO: 27604 - RNA, 21 nt, Artificial Sequence
  Description of Artificial Sequence: Synthetic oligonucleotide
gucagugggcucuaaggauga

SEQ ID NO: 27605 - RNA, 21 nt, Artificial Sequence
  Description of Artificial Sequence: Synthetic oligonucleotide
agucagugggcucuaaggaug

SEQ ID NO: 27606 - RNA, 21 nt, Artificial Sequence
  Description of Artificial Sequence: Synthetic oligonucleotide
cagucagugggcucuaaggau

SEQ ID NO: 27607 - RNA, 21 nt, Artificial Sequence
  Description of Artificial Sequence: Synthetic oligonucleotide
gcagucagugggcucuaagga

SEQ ID NO: 27608 - RNA, 21 nt, Artificial Sequence
  Description of Artificial Sequence: Synthetic oligonucleotide
agcagucagugggcucuaagg

SEQ ID NO: 27609 - RNA, 21 nt, Artificial Sequence
  Description of Artificial Sequence: Synthetic oligonucleotide
gagcagucagugggcucuaag

SEQ ID NO: 27610 - RNA, 21 nt, Artificial Sequence
  Description of Artificial Sequence: Synthetic oligonucleotide
ggagcagucagugggcucuaa

SEQ ID NO: 27611 - RNA, 21 nt, Artificial Sequence
  Description of Artificial Sequence: Synthetic oligonucleotide
gggagcagucagugggcucua

SEQ ID NO: 27612 - RNA, 21 nt, Artificial Sequence
  Description of Artificial Sequence: Synthetic oligonucleotide
ggggagcagucagugggcucu

SEQ ID NO: 27613 - RNA, 21 nt, Artificial Sequence
  Description of Artificial Sequence: Synthetic oligonucleotide
aggggagcagucagugggcuc

SEQ ID NO: 27614 - RNA, 21 nt, Artificial Sequence
  Description of Artificial Sequence: Synthetic oligonucleotide
aaggggagcagucagugggcu

SEQ ID NO: 27615 - RNA, 21 nt, Artificial Sequence
  Description of Artificial Sequence: Synthetic oligonucleotide
aaaggggagcagucagugggc

SEQ ID NO: 27616 - RNA, 21 nt, Artificial Sequence
  Description of Artificial Sequence: Synthetic oligonucleotide
uaaaggggagcagucaguggg

SEQ ID NO: 27617 - RNA, 21 nt, Artificial Sequence
  Description of Artificial Sequence: Synthetic oligonucleotide
auaaaggggagcagucagugg

SEQ ID NO: 27618 - RNA, 21 nt, Artificial Sequence
  Description of Artificial Sequence: Synthetic oligonucleotide
uauaaaggggagcagucagug

SEQ ID NO: 27619 - RNA, 21 nt, Artificial Sequence
  Description of Artificial Sequence: Synthetic oligonucleotide
guauaaaggggagcagucagu

SEQ ID NO: 27620 - RNA, 21 nt, Artificial Sequence
  Description of Artificial Sequence: Synthetic oligonucleotide
gguauaaaggggagcagucag

SEQ ID NO: 27621 - RNA, 21 nt, Artificial Sequence
  Description of Artificial Sequence: Synthetic oligonucleotide
agguauaaaggggagcaguca

SEQ ID NO: 27622 - RNA, 21 nt, Artificial Sequence
  Description of Artificial Sequence: Synthetic oligonucleotide
cagguauaaaggggagcaguc

SEQ ID NO: 27623 - RNA, 21 nt, Artificial Sequence
  Description of Artificial Sequence: Synthetic oligonucleotide
acagguauaaaggggagcagu

SEQ ID NO: 27624 - RNA, 21 nt, Artificial Sequence
  Description of Artificial Sequence: Synthetic oligonucleotide
aacagguauaaaggggagcag

SEQ ID NO: 27625 - RNA, 21 nt, Artificial Sequence
  Description of Artificial Sequence: Synthetic oligonucleotide
caacagguauaaaggggagca

SEQ ID NO: 27626 - RNA, 21 nt, Artificial Sequence
  Description of Artificial Sequence: Synthetic oligonucleotide
ccaacagguauaaaggggagc

SEQ ID NO: 27627 - RNA, 21 nt, Artificial Sequence
  Description of Artificial Sequence: Synthetic oligonucleotide
gccaacagguauaaaggggag

SEQ ID NO: 27628 - RNA, 21 nt, Artificial Sequence
  Description of Artificial Sequence: Synthetic oligonucleotide
ggccaacagguauaaagggga

SEQ ID NO: 27629 - RNA, 21 nt, Artificial Sequence
  Description of Artificial Sequence: Synthetic oligonucleotide
gggccaacagguauaaagggg

SEQ ID NO: 27630 - RNA, 21 nt, Artificial Sequence
  Description of Artificial Sequence: Synthetic oligonucleotide
agggccaacagguauaaaggg

SEQ ID NO: 27631 - RNA, 21 nt, Artificial Sequence
  Description of Artificial Sequence: Synthetic oligonucleotide
cagggccaacagguauaaagg

SEQ ID NO: 27632 - RNA, 21 nt, Artificial Sequence
  Description of Artificial Sequence: Synthetic oligonucleotide
gcagggccaacagguauaaag

SEQ ID NO: 27633 - RNA, 21 nt, Artificial Sequence
  Description of Artificial Sequence: Synthetic oligonucleotide
ggcagggccaacagguauaaa

SEQ ID NO: 27634 - RNA, 21 nt, Artificial Sequence
  Description of Artificial Sequence: Synthetic oligonucleotide
aggcagggccaacagguauaa

SEQ ID NO: 27635 - RNA, 21 nt, Artificial Sequence
  Description of Artificial Sequence: Synthetic oligonucleotide
uaggcagggccaacagguaua

SEQ ID NO: 27636 - RNA, 21 nt, Artificial Sequence
  Description of Artificial Sequence: Synthetic oligonucleotide
auaggcagggccaacagguau

SEQ ID NO: 27637 - RNA, 21 nt, Artificial Sequence
  Description of Artificial Sequence: Synthetic oligonucleotide
uauaggcagggccaacaggua

SEQ ID NO: 27638 - RNA, 21 nt, Artificial Sequence
  Description of Artificial Sequence: Synthetic oligonucleotide
cuauaggcagggccaacaggu

SEQ ID NO: 27639 - RNA, 21 nt, Artificial Sequence
  Description of Artificial Sequence: Synthetic oligonucleotide
ccuauaggcagggccaacagg

SEQ ID NO: 27640 - RNA, 21 nt, Artificial Sequence
  Description of Artificial Sequence: Synthetic oligonucleotide
uccuauaggcagggccaacag

SEQ ID NO: 27641 - RNA, 21 nt, Artificial Sequence
  Description of Artificial Sequence: Synthetic oligonucleotide
cuccuauaggcagggccaaca

SEQ ID NO: 27642 - RNA, 21 nt, Artificial Sequence
  Description of Artificial Sequence: Synthetic oligonucleotide
ucuccuauaggcagggccaac

SEQ ID NO: 27643 - RNA, 21 nt, Artificial Sequence
  Description of Artificial Sequence: Synthetic oligonucleotide
cucuccuauaggcagggccaa

SEQ ID NO: 27644 - RNA, 21 nt, Artificial Sequence
  Description of Artificial Sequence: Synthetic oligonucleotide
ucucuccuauaggcagggcca

SEQ ID NO: 27645 - RNA, 21 nt, Artificial Sequence
  Description of Artificial Sequence: Synthetic oligonucleotide
uucucuccuauaggcagggcc

SEQ ID NO: 27646 - RNA, 21 nt, Artificial Sequence
  Description of Artificial Sequence: Synthetic oligonucleotide
auucucuccuauaggcagggc

SEQ ID NO: 27647 - RNA, 21 nt, Artificial Sequence
  Description of Artificial Sequence: Synthetic oligonucleotide
uauucucuccuauaggcaggg

SEQ ID NO: 27648 - RNA, 21 nt, Artificial Sequence
  Description of Artificial Sequence: Synthetic oligonucleotide
auauucucuccuauaggcagg

SEQ ID NO: 27649 - RNA, 21 nt, Artificial Sequence
  Description of Artificial Sequence: Synthetic oligonucleotide
aauauucucuccuauaggcag

SEQ ID NO: 27650 - RNA, 21 nt, Artificial Sequence
  Description of Artificial Sequence: Synthetic oligonucleotide
aaauauucucuccuauaggca

SEQ ID NO: 27651 - RNA, 21 nt, Artificial Sequence
  Description of Artificial Sequence: Synthetic oligonucleotide
caaauauucucuccuauaggc

SEQ ID NO: 27652 - RNA, 21 nt, Artificial Sequence
  Description of Artificial Sequence: Synthetic oligonucleotide
ccaaauauucucuccuauagg

SEQ ID NO: 27653 - RNA, 21 nt, Artificial Sequence
  Description of Artificial Sequence: Synthetic oligonucleotide
uccaaauauucucuccuauag

SEQ ID NO: 27654 - RNA, 21 nt, Artificial Sequence
  Description of Artificial Sequence: Synthetic oligonucleotide
cuccaaauauucucuccuaua

SEQ ID NO: 27655 - RNA, 21 nt, Artificial Sequence
  Description of Artificial Sequence: Synthetic oligonucleotide
ucuccaaauauucucuccuau

SEQ ID NO: 27656 - RNA, 21 nt, Artificial Sequence
  Description of Artificial Sequence: Synthetic oligonucleotide
aucuccaaauauucucuccua

SEQ ID NO: 27657 - RNA, 21 nt, Artificial Sequence
  Description of Artificial Sequence: Synthetic oligonucleotide
uaucuccaaauauucucuccu

SEQ ID NO: 27658 - RNA, 21 nt, Artificial Sequence
  Description of Artificial Sequence: Synthetic oligonucleotide
cuaucuccaaauauucucucc

SEQ ID NO: 27659 - RNA, 21 nt, Artificial Sequence
  Description of Artificial Sequence: Synthetic oligonucleotide
ccuaucuccaaauauucucuc

SEQ ID NO: 27660 - RNA, 21 nt, Artificial Sequence
  Description of Artificial Sequence: Synthetic oligonucleotide
gccuaucuccaaauauucucu

SEQ ID NO: 27661 - RNA, 21 nt, Artificial Sequence
  Description of Artificial Sequence: Synthetic oligonucleotide
ugccuaucuccaaauauucuc

SEQ ID NO: 27662 - RNA, 21 nt, Artificial Sequence
  Description of Artificial Sequence: Synthetic oligonucleotide
cugccuaucuccaaauauucu

SEQ ID NO: 27663 - RNA, 21 nt, Artificial Sequence
  Description of Artificial Sequence: Synthetic oligonucleotide
gcugccuaucuccaaauauuc

SEQ ID NO: 27664 - RNA, 21 nt, Artificial Sequence
  Description of Artificial Sequence: Synthetic oligonucleotide
agcugccuaucuccaaauauu

SEQ ID NO: 27665 - RNA, 21 nt, Artificial Sequence
  Description of Artificial Sequence: Synthetic oligonucleotide
aagcugccuaucuccaaauau

SEQ ID NO: 27666 - RNA, 21 nt, Artificial Sequence
  Description of Artificial Sequence: Synthetic oligonucleotide
gaagcugccuaucuccaaaua

SEQ ID NO: 27667 - RNA, 21 nt, Artificial Sequence
  Description of Artificial Sequence: Synthetic oligonucleotide
ugaagcugccuaucuccaaau

SEQ ID NO: 27668 - RNA, 21 nt, Artificial Sequence
  Description of Artificial Sequence: Synthetic oligonucleotide
cugaagcugccuaucuccaaa

SEQ ID NO: 27669 - RNA, 21 nt, Artificial Sequence
  Description of Artificial Sequence: Synthetic oligonucleotide
ccugaagcugccuaucuccaa

SEQ ID NO: 27670 - RNA, 21 nt, Artificial Sequence
  Description of Artificial Sequence: Synthetic oligonucleotide
uccugaagcugccuaucucca

SEQ ID NO: 27671 - RNA, 21 nt, Artificial Sequence
  Description of Artificial Sequence: Synthetic oligonucleotide
auccugaagcugccuaucucc

SEQ ID NO: 27672 - RNA, 21 nt, Artificial Sequence
  Description of Artificial Sequence: Synthetic oligonucleotide
cauccugaagcugccuaucuc

SEQ ID NO: 27673 - RNA, 21 nt, Artificial Sequence
  Description of Artificial Sequence: Synthetic oligonucleotide
gcauccugaagcugccuaucu

SEQ ID NO: 27674 - RNA, 21 nt, Artificial Sequence
  Description of Artificial Sequence: Synthetic oligonucleotide
ugcauccugaagcugccuauc

SEQ ID NO: 27675 - RNA, 21 nt, Artificial Sequence
  Description of Artificial Sequence: Synthetic oligonucleotide
augcauccugaagcugccuau

SEQ ID NO: 27676 - RNA, 21 nt, Artificial Sequence
  Description of Artificial Sequence: Synthetic oligonucleotide
aaugcauccugaagcugccua

SEQ ID NO: 27677 - RNA, 21 nt, Artificial Sequence
  Description of Artificial Sequence: Synthetic oligonucleotide
caaugcauccugaagcugccu

SEQ ID NO: 27678 - RNA, 21 nt, Artificial Sequence
  Description of Artificial Sequence: Synthetic oligonucleotide
gcaaugcauccugaagcugcc

SEQ ID NO: 27679 - RNA, 21 nt, Artificial Sequence
  Description of Artificial Sequence: Synthetic oligonucleotide
ugcaaugcauccugaagcugc

SEQ ID NO: 27680 - RNA, 21 nt, Artificial Sequence
  Description of Artificial Sequence: Synthetic oligonucleotide
uugcaaugcauccugaagcug

SEQ ID NO: 27681 - RNA, 21 nt, Artificial Sequence
  Description of Artificial Sequence: Synthetic oligonucleotide
auugcaaugcauccugaagcu

SEQ ID NO: 27682 - RNA, 21 nt, Artificial Sequence
  Description of Artificial Sequence: Synthetic oligonucleotide
gauugcaaugcauccugaagc

SEQ ID NO: 27683 - RNA, 21 nt, Artificial Sequence
  Description of Artificial Sequence: Synthetic oligonucleotide
ugauugcaaugcauccugaag

SEQ ID NO: 27684 - RNA, 21 nt, Artificial Sequence
  Description of Artificial Sequence: Synthetic oligonucleotide
augauugcaaugcauccugaa

SEQ ID NO: 27685 - RNA, 21 nt, Artificial Sequence
  Description of Artificial Sequence: Synthetic oligonucleotide
gaugauugcaaugcauccuga

SEQ ID NO: 27686 - RNA, 21 nt, Artificial Sequence
  Description of Artificial Sequence: Synthetic oligonucleotide
ggaugauugcaaugcauccug

SEQ ID NO: 27687 - RNA, 21 nt, Artificial Sequence
  Description of Artificial Sequence: Synthetic oligonucleotide
aggaugauugcaaugcauccu

SEQ ID NO: 27688 - RNA, 21 nt, Artificial Sequence
  Description of Artificial Sequence: Synthetic oligonucleotide
aaggaugauugcaaugcaucc

SEQ ID NO: 27689 - RNA, 21 nt, Artificial Sequence
  Description of Artificial Sequence: Synthetic oligonucleotide
aaaggaugauugcaaugcauc

SEQ ID NO: 27690 - RNA, 21 nt, Artificial Sequence
  Description of Artificial Sequence: Synthetic oligonucleotide
aaaaggaugauugcaaugcau

SEQ ID NO: 27691 - RNA, 21 nt, Artificial Sequence
  Description of Artificial Sequence: Synthetic oligonucleotide
gaaaaggaugauugcaaugca

SEQ ID NO: 27692 - RNA, 21 nt, Artificial Sequence
  Description of Artificial Sequence: Synthetic oligonucleotide
agaaaaggaugauugcaaugc

SEQ ID NO: 27693 - RNA, 21 nt, Artificial Sequence
  Description of Artificial Sequence: Synthetic oligonucleotide
aagaaaaggaugauugcaaug

SEQ ID NO: 27694 - RNA, 21 nt, Artificial Sequence
  Description of Artificial Sequence: Synthetic oligonucleotide
uaagaaaaggaugauugcaau

SEQ ID NO: 27695 - RNA, 21 nt, Artificial Sequence
  Description of Artificial Sequence: Synthetic oligonucleotide
uuaagaaaaggaugauugcaa

SEQ ID NO: 27696 - RNA, 21 nt, Artificial Sequence
  Description of Artificial Sequence: Synthetic oligonucleotide
uuuaagaaaaggaugauugca

SEQ ID NO: 27697 - RNA, 21 nt, Artificial Sequence
  Description of Artificial Sequence: Synthetic oligonucleotide
auuuaagaaaaggaugauugc

SEQ ID NO: 27698 - RNA, 21 nt, Artificial Sequence
  Description of Artificial Sequence: Synthetic oligonucleotide
aauuuaagaaaaggaugauug

SEQ ID NO: 27699 - RNA, 21 nt, Artificial Sequence
  Description of Artificial Sequence: Synthetic oligonucleotide
uaauuuaagaaaaggaugauu

SEQ ID NO: 27700 - RNA, 21 nt, Artificial Sequence
  Description of Artificial Sequence: Synthetic oligonucleotide
auaauuuaagaaaaggaugau

SEQ ID NO: 27701 - RNA, 21 nt, Artificial Sequence
  Description of Artificial Sequence: Synthetic oligonucleotide
cauaauuuaagaaaaggauga

SEQ ID NO: 27702 - RNA, 21 nt, Artificial Sequence
  Description of Artificial Sequence: Synthetic oligonucleotide
acauaauuuaagaaaaggaug

SEQ ID NO: 27703 - RNA, 21 nt, Artificial Sequence
  Description of Artificial Sequence: Synthetic oligonucleotide
gacauaauuuaagaaaaggau

SEQ ID NO: 27704 - RNA, 21 nt, Artificial Sequence
  Description of Artificial Sequence: Synthetic oligonucleotide
ugacauaauuuaagaaaagga

SEQ ID NO: 27705 - RNA, 21 nt, Artificial Sequence
  Description of Artificial Sequence: Synthetic oligonucleotide
gugacauaauuuaagaaaagg

SEQ ID NO: 27706 - RNA, 21 nt, Artificial Sequence
  Description of Artificial Sequence: Synthetic oligonucleotide
agugacauaauuuaagaaaag

SEQ ID NO: 27707 - RNA, 21 nt, Artificial Sequence
  Description of Artificial Sequence: Synthetic oligonucleotide
uagugacauaauuuaagaaaa

SEQ ID NO: 27708 - RNA, 21 nt, Artificial Sequence
  Description of Artificial Sequence: Synthetic oligonucleotide
cuagugacauaauuuaagaaa

SEQ ID NO: 27709 - RNA, 21 nt, Artificial Sequence
  Description of Artificial Sequence: Synthetic oligonucleotide
acuagugacauaauuuaagaa

SEQ ID NO: 27710 - RNA, 21 nt, Artificial Sequence
  Description of Artificial Sequence: Synthetic oligonucleotide
gacuagugacauaauuuaaga

SEQ ID NO: 27711 - RNA, 21 nt, Artificial Sequence
  Description of Artificial Sequence: Synthetic oligonucleotide
agacuagugacauaauuuaag

SEQ ID NO: 27712 - RNA, 21 nt, Artificial Sequence
  Description of Artificial Sequence: Synthetic oligonucleotide
aagacuagugacauaauuuaa

SEQ ID NO: 27713 - RNA, 21 nt, Artificial Sequence
  Description of Artificial Sequence: Synthetic oligonucleotide
aaagacuagugacauaauuua

SEQ ID NO: 27714 - RNA, 21 nt, Artificial Sequence
  Description of Artificial Sequence: Synthetic oligonucleotide
aaaagacuagugacauaauuu

SEQ ID NO: 27715 - RNA, 21 nt, Artificial Sequence
  Description of Artificial Sequence: Synthetic oligonucleotide
uaaaagacuagugacauaauu

SEQ ID NO: 27716 - RNA, 21 nt, Artificial Sequence
  Description of Artificial Sequence: Synthetic oligonucleotide
auaaaagacuagugacauaau

SEQ ID NO: 27717 - RNA, 21 nt, Artificial Sequence
  Description of Artificial Sequence: Synthetic oligonucleotide
aauaaaagacuagugacauaa

SEQ ID NO: 27718 - RNA, 21 nt, Artificial Sequence
  Description of Artificial Sequence: Synthetic oligonucleotide
aaauaaaagacuagugacaua

SEQ ID NO: 27719 - RNA, 21 nt, Artificial Sequence
  Description of Artificial Sequence: Synthetic oligonucleotide
aaaauaaaagacuagugacau

SEQ ID NO: 27720 - RNA, 21 nt, Artificial Sequence
  Description of Artificial Sequence: Synthetic oligonucleotide
aaaaauaaaagacuagugaca

SEQ ID NO: 27721 - RNA, 21 nt, Artificial Sequence
  Description of Artificial Sequence: Synthetic oligonucleotide
aaaaaauaaaagacuagugac

SEQ ID NO: 27722 - RNA, 21 nt, Artificial Sequence
  Description of Artificial Sequence: Synthetic oligonucleotide
gaaaaaauaaaagacuaguga

SEQ ID NO: 27723 - RNA, 21 nt, Artificial Sequence
  Description of Artificial Sequence: Synthetic oligonucleotide
ggaaaaaauaaaagacuagug

SEQ ID NO: 27724 - RNA, 21 nt, Artificial Sequence
  Description of Artificial Sequence: Synthetic oligonucleotide
gggaaaaaauaaaagacuagu

SEQ ID NO: 27725 - RNA, 21 nt, Artificial Sequence
  Description of Artificial Sequence: Synthetic oligonucleotide
ggggaaaaaauaaaagacuag

SEQ ID NO: 27726 - RNA, 21 nt, Artificial Sequence
  Description of Artificial Sequence: Synthetic oligonucleotide
aggggaaaaaauaaaagacua

SEQ ID NO: 27727 - RNA, 21 nt, Artificial Sequence
  Description of Artificial Sequence: Synthetic oligonucleotide
gaggggaaaaaauaaaagacu

SEQ ID NO: 27728 - RNA, 21 nt, Artificial Sequence
  Description of Artificial Sequence: Synthetic oligonucleotide
agaggggaaaaaauaaaagac

SEQ ID NO: 27729 - RNA, 21 nt, Artificial Sequence
  Description of Artificial Sequence: Synthetic oligonucleotide
aagaggggaaaaaauaaaaga

SEQ ID NO: 27730 - RNA, 21 nt, Artificial Sequence
  Description of Artificial Sequence: Synthetic oligonucleotide
caagaggggaaaaaauaaaag

SEQ ID NO: 27731 - RNA, 21 nt, Artificial Sequence
  Description of Artificial Sequence: Synthetic oligonucleotide
ucaagaggggaaaaaauaaaa

SEQ ID NO: 27732 - RNA, 21 nt, Artificial Sequence
  Description of Artificial Sequence: Synthetic oligonucleotide
uucaagaggggaaaaaauaaa

SEQ ID NO: 27733 - RNA, 21 nt, Artificial Sequence
  Description of Artificial Sequence: Synthetic oligonucleotide
guucaagaggggaaaaaauaa

SEQ ID NO: 27734 - RNA, 21 nt, Artificial Sequence
  Description of Artificial Sequence: Synthetic oligonucleotide
aguucaagaggggaaaaaaua

SEQ ID NO: 27735 - RNA, 21 nt, Artificial Sequence
  Description of Artificial Sequence: Synthetic oligonucleotide
aaguucaagaggggaaaaaau

SEQ ID NO: 27736 - RNA, 21 nt, Artificial Sequence
  Description of Artificial Sequence: Synthetic oligonucleotide
aaaguucaagaggggaaaaaa

SEQ ID NO: 27737 - RNA, 21 nt, Artificial Sequence
  Description of Artificial Sequence: Synthetic oligonucleotide
gaaaguucaagaggggaaaaa

SEQ ID NO: 27738 - RNA, 21 nt, Artificial Sequence
  Description of Artificial Sequence: Synthetic oligonucleotide
ggaaaguucaagaggggaaaa

SEQ ID NO: 27739 - RNA, 21 nt, Artificial Sequence
  Description of Artificial Sequence: Synthetic oligonucleotide
aggaaaguucaagaggggaaa

SEQ ID NO: 27740 - RNA, 21 nt, Artificial Sequence
  Description of Artificial Sequence: Synthetic oligonucleotide
gaggaaaguucaagaggggaa

SEQ ID NO: 27741 - RNA, 21 nt, Artificial Sequence
  Description of Artificial Sequence: Synthetic oligonucleotide
ugaggaaaguucaagagggga

SEQ ID NO: 27742 - RNA, 21 nt, Artificial Sequence
  Description of Artificial Sequence: Synthetic oligonucleotide
gugaggaaaguucaagagggg

SEQ ID NO: 27743 - RNA, 21 nt, Artificial Sequence
  Description of Artificial Sequence: Synthetic oligonucleotide
ugugaggaaaguucaagaggg

SEQ ID NO: 27744 - RNA, 21 nt, Artificial Sequence
  Description of Artificial Sequence: Synthetic oligonucleotide
gugugaggaaaguucaagagg

SEQ ID NO: 27745 - RNA, 21 nt, Artificial Sequence
  Description of Artificial Sequence: Synthetic oligonucleotide
ggugugaggaaaguucaagag

SEQ ID NO: 27746 - RNA, 21 nt, Artificial Sequence
  Description of Artificial Sequence: Synthetic oligonucleotide
aggugugaggaaaguucaaga

SEQ ID NO: 27747 - RNA, 21 nt, Artificial Sequence
  Description of Artificial Sequence: Synthetic oligonucleotide
caggugugaggaaaguucaag

SEQ ID NO: 27748 - RNA, 21 nt, Artificial Sequence
  Description of Artificial Sequence: Synthetic oligonucleotide
ccaggugugaggaaaguucaa

SEQ ID NO: 27749 - RNA, 21 nt, Artificial Sequence
  Description of Artificial Sequence: Synthetic oligonucleotide
uccaggugugaggaaaguuca

SEQ ID NO: 27750 - RNA, 21 nt, Artificial Sequence
  Description of Artificial Sequence: Synthetic oligonucleotide
uuccaggugugaggaaaguuc

SEQ ID NO: 27751 - RNA, 21 nt, Artificial Sequence
  Description of Artificial Sequence: Synthetic oligonucleotide
cuuccaggugugaggaaaguu

SEQ ID NO: 27752 - RNA, 21 nt, Artificial Sequence
  Description of Artificial Sequence: Synthetic oligonucleotide
ucuuccaggugugaggaaagu

SEQ ID NO: 27753 - RNA, 21 nt, Artificial Sequence
  Description of Artificial Sequence: Synthetic oligonucleotide
uucuuccaggugugaggaaag

SEQ ID NO: 27754 - RNA, 21 nt, Artificial Sequence
  Description of Artificial Sequence: Synthetic oligonucleotide
uuucuuccaggugugaggaaa

SEQ ID NO: 27755 - RNA, 21 nt, Artificial Sequence
  Description of Artificial Sequence: Synthetic oligonucleotide
guuucuuccaggugugaggaa

SEQ ID NO: 27756 - RNA, 21 nt, Artificial Sequence
  Description of Artificial Sequence: Synthetic oligonucleotide
uguuucuuccaggugugagga

SEQ ID NO: 27757 - RNA, 21 nt, Artificial Sequence
  Description of Artificial Sequence: Synthetic oligonucleotide
uuguuucuuccaggugugagg

SEQ ID NO: 27758 - RNA, 21 nt, Artificial Sequence
  Description of Artificial Sequence: Synthetic oligonucleotide
uuuguuucuuccaggugugag

SEQ ID NO: 27759 - RNA, 21 nt, Artificial Sequence
  Description of Artificial Sequence: Synthetic oligonucleotide
cuuuguuucuuccagguguga

SEQ ID NO: 27760 - RNA, 21 nt, Artificial Sequence
  Description of Artificial Sequence: Synthetic oligonucleotide
acuuuguuucuuccaggugug

SEQ ID NO: 27761 - RNA, 21 nt, Artificial Sequence
  Description of Artificial Sequence: Synthetic oligonucleotide
uacuuuguuucuuccaggugu

SEQ ID NO: 27762 - RNA, 21 nt, Artificial Sequence
  Description of Artificial Sequence: Synthetic oligonucleotide
cuacuuuguuucuuccaggug

SEQ ID NO: 27763 - RNA, 21 nt, Artificial Sequence
  Description of Artificial Sequence: Synthetic oligonucleotide
ccuacuuuguuucuuccaggu

SEQ ID NO: 27764 - RNA, 21 nt, Artificial Sequence
  Description of Artificial Sequence: Synthetic oligonucleotide
uccuacuuuguuucuuccagg

SEQ ID NO: 27765 - RNA, 21 nt, Artificial Sequence
  Description of Artificial Sequence: Synthetic oligonucleotide
uuccuacuuuguuucuuccag

SEQ ID NO: 27766 - RNA, 21 nt, Artificial Sequence
  Description of Artificial Sequence: Synthetic oligonucleotide
uuuccuacuuuguuucuucca

SEQ ID NO: 27767 - RNA, 21 nt, Artificial Sequence
  Description of Artificial Sequence: Synthetic oligonucleotide
uuuuccuacuuuguuucuucc

SEQ ID NO: 27768 - RNA, 21 nt, Artificial Sequence
  Description of Artificial Sequence: Synthetic oligonucleotide
uuuuuccuacuuuguuucuuc

SEQ ID NO: 27769 - RNA, 21 nt, Artificial Sequence
  Description of Artificial Sequence: Synthetic oligonucleotide
cuuuuuccuacuuuguuucuu

SEQ ID NO: 27770 - RNA, 21 nt, Artificial Sequence
  Description of Artificial Sequence: Synthetic oligonucleotide
acuuuuuccuacuuuguuucu

SEQ ID NO: 27771 - RNA, 21 nt, Artificial Sequence
  Description of Artificial Sequence: Synthetic oligonucleotide
cacuuuuuccuacuuuguuuc

SEQ ID NO: 27772 - RNA, 21 nt, Artificial Sequence
  Description of Artificial Sequence: Synthetic oligonucleotide
ucacuuuuuccuacuuuguuu

SEQ ID NO: 27773 - RNA, 21 nt, Artificial Sequence
  Description of Artificial Sequence: Synthetic oligonucleotide
uucacuuuuuccuacuuuguu

SEQ ID NO: 27774 - RNA, 21 nt, Artificial Sequence
  Description of Artificial Sequence: Synthetic oligonucleotide
guucacuuuuuccuacuuugu

SEQ ID NO: 27775 - RNA, 21 nt, Artificial Sequence
  Description of Artificial Sequence: Synthetic oligonucleotide
uguucacuuuuuccuacuuug

SEQ ID NO: 27776 - RNA, 21 nt, Artificial Sequence
  Description of Artificial Sequence: Synthetic oligonucleotide
cuguucacuuuuuccuacuuu

SEQ ID NO: 27777 - RNA, 21 nt, Artificial Sequence
  Description of Artificial Sequence: Synthetic oligonucleotide
ccuguucacuuuuuccuacuu

SEQ ID NO: 27778 - RNA, 21 nt, Artificial Sequence
  Description of Artificial Sequence: Synthetic oligonucleotide
cccuguucacuuuuuccuacu

SEQ ID NO: 27779 - RNA, 21 nt, Artificial Sequence
  Description of Artificial Sequence: Synthetic oligonucleotide
ccccuguucacuuuuuccuac

SEQ ID NO: 27780 - RNA, 21 nt, Artificial Sequence
  Description of Artificial Sequence: Synthetic oligonucleotide
uccccuguucacuuuuuccua

SEQ ID NO: 27781 - RNA, 21 nt, Artificial Sequence
  Description of Artificial Sequence: Synthetic oligonucleotide
auccccuguucacuuuuuccu

SEQ ID NO: 27782 - RNA, 21 nt, Artificial Sequence
  Description of Artificial Sequence: Synthetic oligonucleotide
cauccccuguucacuuuuucc

SEQ ID NO: 27783 - RNA, 21 nt, Artificial Sequence
  Description of Artificial Sequence: Synthetic oligonucleotide
acauccccuguucacuuuuuc

SEQ ID NO: 27784 - RNA, 21 nt, Artificial Sequence
  Description of Artificial Sequence: Synthetic oligonucleotide
gacauccccuguucacuuuuu

SEQ ID NO: 27785 - RNA, 21 nt, Artificial Sequence
  Description of Artificial Sequence: Synthetic oligonucleotide
ugacauccccuguucacuuuu

SEQ ID NO: 27786 - RNA, 21 nt, Artificial Sequence
  Description of Artificial Sequence: Synthetic oligonucleotide
uugacauccccuguucacuuu

SEQ ID NO: 27787 - RNA, 21 nt, Artificial Sequence
  Description of Artificial Sequence: Synthetic oligonucleotide
uuugacauccccuguucacuu

SEQ ID NO: 27788 - RNA, 21 nt, Artificial Sequence
  Description of Artificial Sequence: Synthetic oligonucleotide
auuugacauccccuguucacu

SEQ ID NO: 27789 - RNA, 21 nt, Artificial Sequence
  Description of Artificial Sequence: Synthetic oligonucleotide
gauuugacauccccuguucac

SEQ ID NO: 27790 - RNA, 21 nt, Artificial Sequence
  Description of Artificial Sequence: Synthetic oligonucleotide
cgauuugacauccccuguuca

SEQ ID NO: 27791 - RNA, 21 nt, Artificial Sequence
  Description of Artificial Sequence: Synthetic oligonucleotide
ucgauuugacauccccuguuc

SEQ ID NO: 27792 - RNA, 21 nt, Artificial Sequence
  Description of Artificial Sequence: Synthetic oligonucleotide
aucgauuugacauccccuguu

SEQ ID NO: 27793 - RNA, 21 nt, Artificial Sequence
  Description of Artificial Sequence: Synthetic oligonucleotide
aaucgauuugacauccccugu

SEQ ID NO: 27794 - RNA, 21 nt, Artificial Sequence
  Description of Artificial Sequence: Synthetic oligonucleotide
gaaucgauuugacauccccug

SEQ ID NO: 27795 - RNA, 21 nt, Artificial Sequence
  Description of Artificial Sequence: Synthetic oligonucleotide
agaaucgauuugacauccccu

SEQ ID NO: 27796 - RNA, 21 nt, Artificial Sequence
  Description of Artificial Sequence: Synthetic oligonucleotide
aagaaucgauuugacaucccc

SEQ ID NO: 27797 - RNA, 21 nt, Artificial Sequence
  Description of Artificial Sequence: Synthetic oligonucleotide
caagaaucgauuugacauccc

SEQ ID NO: 27798 - RNA, 21 nt, Artificial Sequence
  Description of Artificial Sequence: Synthetic oligonucleotide
ucaagaaucgauuugacaucc

SEQ ID NO: 27799 - RNA, 21 nt, Artificial Sequence
  Description of Artificial Sequence: Synthetic oligonucleotide
uucaagaaucgauuugacauc

SEQ ID NO: 27800 - RNA, 21 nt, Artificial Sequence
  Description of Artificial Sequence: Synthetic oligonucleotide
auucaagaaucgauuugacau

SEQ ID NO: 27801 - RNA, 21 nt, Artificial Sequence
  Description of Artificial Sequence: Synthetic oligonucleotide
aauucaagaaucgauuugaca

SEQ ID NO: 27802 - RNA, 21 nt, Artificial Sequence
  Description of Artificial Sequence: Synthetic oligonucleotide
gaauucaagaaucgauuugac

SEQ ID NO: 27803 - RNA, 21 nt, Artificial Sequence
  Description of Artificial Sequence: Synthetic oligonucleotide
ggaauucaagaaucgauuuga

SEQ ID NO: 27804 - RNA, 21 nt, Artificial Sequence
  Description of Artificial Sequence: Synthetic oligonucleotide
gggaauucaagaaucgauuug

SEQ ID NO: 27805 - RNA, 21 nt, Artificial Sequence
  Description of Artificial Sequence: Synthetic oligonucleotide
cgggaauucaagaaucgauuu

SEQ ID NO: 27806 - RNA, 21 nt, Artificial Sequence
  Description of Artificial Sequence: Synthetic oligonucleotide
gcgggaauucaagaaucgauu

SEQ ID NO: 27807 - RNA, 21 nt, Artificial Sequence
  Description of Artificial Sequence: Synthetic oligonucleotide
agcgggaauucaagaaucgau

SEQ ID NO: 27808 - RNA, 21 nt, Artificial Sequence
  Description of Artificial Sequence: Synthetic oligonucleotide
cagcgggaauucaagaaucga

SEQ ID NO: 27809 - RNA, 21 nt, Artificial Sequence
  Description of Artificial Sequence: Synthetic oligonucleotide
gcagcgggaauucaagaaucg

SEQ ID NO: 27810 - RNA, 21 nt, Artificial Sequence
  Description of Artificial Sequence: Synthetic oligonucleotide
ugcagcgggaauucaagaauc

SEQ ID NO: 27811 - RNA, 21 nt, Artificial Sequence
  Description of Artificial Sequence: Synthetic oligonucleotide
uugcagcgggaauucaagaau

SEQ ID NO: 27812 - RNA, 21 nt, Artificial Sequence
  Description of Artificial Sequence: Synthetic oligonucleotide
cuugcagcgggaauucaagaa

SEQ ID NO: 27813 - RNA, 21 nt, Artificial Sequence
  Description of Artificial Sequence: Synthetic oligonucleotide
gcuugcagcgggaauucaaga

SEQ ID NO: 27814 - RNA, 21 nt, Artificial Sequence
  Description of Artificial Sequence: Synthetic oligonucleotide
agcuugcagcgggaauucaag

SEQ ID NO: 27815 - RNA, 21 nt, Artificial Sequence
  Description of Artificial Sequence: Synthetic oligonucleotide
uagcuugcagcgggaauucaa

SEQ ID NO: 27816 - RNA, 21 nt, Artificial Sequence
  Description of Artificial Sequence: Synthetic oligonucleotide
cuagcuugcagcgggaauuca

SEQ ID NO: 27817 - RNA, 21 nt, Artificial Sequence
  Description of Artificial Sequence: Synthetic oligonucleotide
ucuagcuugcagcgggaauuc

SEQ ID NO: 27818 - RNA, 21 nt, Artificial Sequence
  Description of Artificial Sequence: Synthetic oligonucleotide
cucuagcuugcagcgggaauu

SEQ ID NO: 27819 - RNA, 21 nt, Artificial Sequence
  Description of Artificial Sequence: Synthetic oligonucleotide
gcucuagcuugcagcgggaau

SEQ ID NO: 27820 - RNA, 21 nt, Artificial Sequence
  Description of Artificial Sequence: Synthetic oligonucleotide
ggcucuagcuugcagcgggaa

SEQ ID NO: 27821 - RNA, 21 nt, Artificial Sequence
  Description of Artificial Sequence: Synthetic oligonucleotide
cggcucuagcuugcagcggga

SEQ ID NO: 27822 - RNA, 21 nt, Artificial Sequence
  Description of Artificial Sequence: Synthetic oligonucleotide
gcggcucuagcuugcagcggg

SEQ ID NO: 27823 - RNA, 21 nt, Artificial Sequence
  Description of Artificial Sequence: Synthetic oligonucleotide
ugcggcucuagcuugcagcgg

SEQ ID NO: 27824 - RNA, 21 nt, Artificial Sequence
  Description of Artificial Sequence: Synthetic oligonucleotide
cugcggcucuagcuugcagcg

SEQ ID NO: 27825 - RNA, 21 nt, Artificial Sequence
  Description of Artificial Sequence: Synthetic oligonucleotide
ccugcggcucuagcuugcagc

SEQ ID NO: 27826 - RNA, 21 nt, Artificial Sequence
  Description of Artificial Sequence: Synthetic oligonucleotide
gccugcggcucuagcuugcag

SEQ ID NO: 27827 - RNA, 21 nt, Artificial Sequence
  Description of Artificial Sequence: Synthetic oligonucleotide
ugccugcggcucuagcuugca

SEQ ID NO: 27828 - RNA, 21 nt, Artificial Sequence
  Description of Artificial Sequence: Synthetic oligonucleotide
gugccugcggcucuagcuugc

SEQ ID NO: 27829 - RNA, 21 nt, Artificial Sequence
  Description of Artificial Sequence: Synthetic oligonucleotide
ggugccugcggcucuagcuug

SEQ ID NO: 27830 - RNA, 21 nt, Artificial Sequence
  Description of Artificial Sequence: Synthetic oligonucleotide
gggugccugcggcucuagcuu

SEQ ID NO: 27831 - RNA, 21 nt, Artificial Sequence
  Description of Artificial Sequence: Synthetic oligonucleotide
agggugccugcggcucuagcu

SEQ ID NO: 27832 - RNA, 21 nt, Artificial Sequence
  Description of Artificial Sequence: Synthetic oligonucleotide
gagggugccugcggcucuagc

SEQ ID NO: 27833 - RNA, 21 nt, Artificial Sequence
  Description of Artificial Sequence: Synthetic oligonucleotide
agagggugccugcggcucuag

SEQ ID NO: 27834 - RNA, 21 nt, Artificial Sequence
  Description of Artificial Sequence: Synthetic oligonucleotide
gagagggugccugcggcucua

SEQ ID NO: 27835 - RNA, 21 nt, Artificial Sequence
  Description of Artificial Sequence: Synthetic oligonucleotide
ugagagggugccugcggcucu

SEQ ID NO: 27836 - RNA, 21 nt, Artificial Sequence
  Description of Artificial Sequence: Synthetic oligonucleotide
gugagagggugccugcggcuc

SEQ ID NO: 27837 - RNA, 21 nt, Artificial Sequence
  Description of Artificial Sequence: Synthetic oligonucleotide
agugagagggugccugcggcu

SEQ ID NO: 27838 - RNA, 21 nt, Artificial Sequence
  Description of Artificial Sequence: Synthetic oligonucleotide
gagugagagggugccugcggc

SEQ ID NO: 27839 - RNA, 21 nt, Artificial Sequence
  Description of Artificial Sequence: Synthetic oligonucleotide
ugagugagagggugccugcgg

SEQ ID NO: 27840 - RNA, 21 nt, Artificial Sequence
  Description of Artificial Sequence: Synthetic oligonucleotide
uugagugagagggugccugcg

SEQ ID NO: 27841 - RNA, 21 nt, Artificial Sequence
  Description of Artificial Sequence: Synthetic oligonucleotide
auugagugagagggugccugc

SEQ ID NO: 27842 - RNA, 21 nt, Artificial Sequence
  Description of Artificial Sequence: Synthetic oligonucleotide
aauugagugagagggugccug

SEQ ID NO: 27843 - RNA, 21 nt, Artificial Sequence
  Description of Artificial Sequence: Synthetic oligonucleotide
aaauugagugagagggugccu

SEQ ID NO: 27844 - RNA, 21 nt, Artificial Sequence
  Description of Artificial Sequence: Synthetic oligonucleotide
gaaauugagugagagggugcc

SEQ ID NO: 27845 - RNA, 21 nt, Artificial Sequence
  Description of Artificial Sequence: Synthetic oligonucleotide
ggaaauugagugagagggugc

SEQ ID NO: 27846 - RNA, 21 nt, Artificial Sequence
  Description of Artificial Sequence: Synthetic oligonucleotide
uggaaauugagugagagggug

SEQ ID NO: 27847 - RNA, 21 nt, Artificial Sequence
  Description of Artificial Sequence: Synthetic oligonucleotide
guggaaauugagugagagggu

SEQ ID NO: 27848 - RNA, 21 nt, Artificial Sequence
  Description of Artificial Sequence: Synthetic oligonucleotide
aguggaaauugagugagaggg

SEQ ID NO: 27849 - RNA, 21 nt, Artificial Sequence
  Description of Artificial Sequence: Synthetic oligonucleotide
gaguggaaauugagugagagg

SEQ ID NO: 27850 - RNA, 21 nt, Artificial Sequence
  Description of Artificial Sequence: Synthetic oligonucleotide
ugaguggaaauugagugagag

SEQ ID NO: 27851 - RNA, 21 nt, Artificial Sequence
  Description of Artificial Sequence: Synthetic oligonucleotide
cugaguggaaauugagugaga

SEQ ID NO: 27852 - RNA, 21 nt, Artificial Sequence
  Description of Artificial Sequence: Synthetic oligonucleotide
ucugaguggaaauugagugag

SEQ ID NO: 27853 - RNA, 21 nt, Artificial Sequence
  Description of Artificial Sequence: Synthetic oligonucleotide
uucugaguggaaauugaguga

SEQ ID NO: 27854 - RNA, 21 nt, Artificial Sequence
  Description of Artificial Sequence: Synthetic oligonucleotide
guucugaguggaaauugagug

SEQ ID NO: 27855 - RNA, 21 nt, Artificial Sequence
  Description of Artificial Sequence: Synthetic oligonucleotide
gguucugaguggaaauugagu

SEQ ID NO: 27856 - RNA, 21 nt, Artificial Sequence
  Description of Artificial Sequence: Synthetic oligonucleotide
ggguucugaguggaaauugag

SEQ ID NO: 27857 - RNA, 21 nt, Artificial Sequence
  Description of Artificial Sequence: Synthetic oligonucleotide
aggguucugaguggaaauuga

SEQ ID NO: 27858 - RNA, 21 nt, Artificial Sequence
  Description of Artificial Sequence: Synthetic oligonucleotide
uaggguucugaguggaaauug

SEQ ID NO: 27859 - RNA, 21 nt, Artificial Sequence
  Description of Artificial Sequence: Synthetic oligonucleotide
auaggguucugaguggaaauu

SEQ ID NO: 27860 - RNA, 21 nt, Artificial Sequence
  Description of Artificial Sequence: Synthetic oligonucleotide
uauaggguucugaguggaaau

SEQ ID NO: 27861 - RNA, 21 nt, Artificial Sequence
  Description of Artificial Sequence: Synthetic oligonucleotide
uuauaggguucugaguggaaa

SEQ ID NO: 27862 - RNA, 21 nt, Artificial Sequence
  Description of Artificial Sequence: Synthetic oligonucleotide
uuuauaggguucugaguggaa

SEQ ID NO: 27863 - RNA, 21 nt, Artificial Sequence
  Description of Artificial Sequence: Synthetic oligonucleotide
guuuauaggguucugagugga

SEQ ID NO: 27864 - RNA, 21 nt, Artificial Sequence
  Description of Artificial Sequence: Synthetic oligonucleotide
uguuuauaggguucugagugg

SEQ ID NO: 27865 - RNA, 21 nt, Artificial Sequence
  Description of Artificial Sequence: Synthetic oligonucleotide
guguuuauaggguucugagug

SEQ ID NO: 27866 - RNA, 21 nt, Artificial Sequence
  Description of Artificial Sequence: Synthetic oligonucleotide
gguguuuauaggguucugagu

SEQ ID NO: 27867 - RNA, 21 nt, Artificial Sequence
  Description of Artificial Sequence: Synthetic oligonucleotide
ugguguuuauaggguucugag

SEQ ID NO: 27868 - RNA, 21 nt, Artificial Sequence
  Description of Artificial Sequence: Synthetic oligonucleotide
cugguguuuauaggguucuga

SEQ ID NO: 27869 - RNA, 21 nt, Artificial Sequence
  Description of Artificial Sequence: Synthetic oligonucleotide
acugguguuuauaggguucug

SEQ ID NO: 27870 - RNA, 21 nt, Artificial Sequence
  Description of Artificial Sequence: Synthetic oligonucleotide
cacugguguuuauaggguucu

SEQ ID NO: 27871 - RNA, 21 nt, Artificial Sequence
  Description of Artificial Sequence: Synthetic oligonucleotide
ccacugguguuuauaggguuc

SEQ ID NO: 27872 - RNA, 21 nt, Artificial Sequence
  Description of Artificial Sequence: Synthetic oligonucleotide
cccacugguguuuauaggguu

SEQ ID NO: 27873 - RNA, 21 nt, Artificial Sequence
  Description of Artificial Sequence: Synthetic oligonucleotide
ucccacugguguuuauagggu

SEQ ID NO: 27874 - RNA, 21 nt, Artificial Sequence
  Description of Artificial Sequence: Synthetic oligonucleotide
uucccacugguguuuauaggg

SEQ ID NO: 27875 - RNA, 21 nt, Artificial Sequence
  Description of Artificial Sequence: Synthetic oligonucleotide
cuucccacugguguuuauagg

SEQ ID NO: 27876 - RNA, 21 nt, Artificial Sequence
  Description of Artificial Sequence: Synthetic oligonucleotide
ccuucccacugguguuuauag

SEQ ID NO: 27877 - RNA, 21 nt, Artificial Sequence
  Description of Artificial Sequence: Synthetic oligonucleotide
cccuucccacugguguuuaua

SEQ ID NO: 27878 - RNA, 21 nt, Artificial Sequence
  Description of Artificial Sequence: Synthetic oligonucleotide
gcccuucccacugguguuuau

SEQ ID NO: 27879 - RNA, 21 nt, Artificial Sequence
  Description of Artificial Sequence: Synthetic oligonucleotide
ugcccuucccacugguguuua

SEQ ID NO: 27880 - RNA, 21 nt, Artificial Sequence
  Description of Artificial Sequence: Synthetic oligonucleotide
uugcccuucccacugguguuu

SEQ ID NO: 27881 - RNA, 21 nt, Artificial Sequence
  Description of Artificial Sequence: Synthetic oligonucleotide
guugcccuucccacugguguu

SEQ ID NO: 27882 - RNA, 21 nt, Artificial Sequence
  Description of Artificial Sequence: Synthetic oligonucleotide
gguugcccuucccacuggugu

SEQ ID NO: 27883 - RNA, 21 nt, Artificial Sequence
  Description of Artificial Sequence: Synthetic oligonucleotide
ggguugcccuucccacuggug

SEQ ID NO: 27884 - RNA, 21 nt, Artificial Sequence
  Description of Artificial Sequence: Synthetic oligonucleotide
uggguugcccuucccacuggu

SEQ ID NO: 27885 - RNA, 21 nt, Artificial Sequence
  Description of Artificial Sequence: Synthetic oligonucleotide
guggguugcccuucccacugg

SEQ ID NO: 27886 - RNA, 21 nt, Artificial Sequence
  Description of Artificial Sequence: Synthetic oligonucleotide
aguggguugcccuucccacug

SEQ ID NO: 27887 - RNA, 21 nt, Artificial Sequence
  Description of Artificial Sequence: Synthetic oligonucleotide
caguggguugcccuucccacu

SEQ ID NO: 27888 - RNA, 21 nt, Artificial Sequence
  Description of Artificial Sequence: Synthetic oligonucleotide
gcaguggguugcccuucccac

SEQ ID NO: 27889 - RNA, 21 nt, Artificial Sequence
  Description of Artificial Sequence: Synthetic oligonucleotide
ugcaguggguugcccuuccca

SEQ ID NO: 27890 - RNA, 21 nt, Artificial Sequence
  Description of Artificial Sequence: Synthetic oligonucleotide
gugcaguggguugcccuuccc

SEQ ID NO: 27891 - RNA, 21 nt, Artificial Sequence
  Description of Artificial Sequence: Synthetic oligonucleotide
cgugcaguggguugcccuucc

SEQ ID NO: 27892 - RNA, 21 nt, Artificial Sequence
  Description of Artificial Sequence: Synthetic oligonucleotide
acgugcaguggguugcccuuc

SEQ ID NO: 27893 - RNA, 21 nt, Artificial Sequence
  Description of Artificial Sequence: Synthetic oligonucleotide
cacgugcaguggguugcccuu

SEQ ID NO: 27894 - RNA, 21 nt, Artificial Sequence
  Description of Artificial Sequence: Synthetic oligonucleotide
ccacgugcaguggguugcccu

SEQ ID NO: 27895 - RNA, 21 nt, Artificial Sequence
  Description of Artificial Sequence: Synthetic oligonucleotide
cccacgugcaguggguugccc

SEQ ID NO: 27896 - RNA, 21 nt, Artificial Sequence
  Description of Artificial Sequence: Synthetic oligonucleotide
ucccacgugcaguggguugcc

SEQ ID NO: 27897 - RNA, 21 nt, Artificial Sequence
  Description of Artificial Sequence: Synthetic oligonucleotide
uucccacgugcaguggguugc

SEQ ID NO: 27898 - RNA, 21 nt, Artificial Sequence
  Description of Artificial Sequence: Synthetic oligonucleotide
auucccacgugcaguggguug

SEQ ID NO: 27899 - RNA, 21 nt, Artificial Sequence
  Description of Artificial Sequence: Synthetic oligonucleotide
cauucccacgugcaguggguu

SEQ ID NO: 27900 - RNA, 21 nt, Artificial Sequence
  Description of Artificial Sequence: Synthetic oligonucleotide
gcauucccacgugcagugggu

SEQ ID NO: 27901 - RNA, 21 nt, Artificial Sequence
  Description of Artificial Sequence: Synthetic oligonucleotide
ugcauucccacgugcaguggg

SEQ ID NO: 27902 - RNA, 21 nt, Artificial Sequence
  Description of Artificial Sequence: Synthetic oligonucleotide
gugcauucccacgugcagugg

SEQ ID NO: 27903 - RNA, 21 nt, Artificial Sequence
  Description of Artificial Sequence: Synthetic oligonucleotide
agugcauucccacgugcagug

SEQ ID NO: 27904 - RNA, 21 nt, Artificial Sequence
  Description of Artificial Sequence: Synthetic oligonucleotide
cagugcauucccacgugcagu

SEQ ID NO: 27905 - RNA, 21 nt, Artificial Sequence
  Description of Artificial Sequence: Synthetic oligonucleotide
ucagugcauucccacgugcag

SEQ ID NO: 27906 - RNA, 21 nt, Artificial Sequence
  Description of Artificial Sequence: Synthetic oligonucleotide
aucagugcauucccacgugca

SEQ ID NO: 27907 - RNA, 21 nt, Artificial Sequence
  Description of Artificial Sequence: Synthetic oligonucleotide
aaucagugcauucccacgugc

SEQ ID NO: 27908 - RNA, 21 nt, Artificial Sequence
  Description of Artificial Sequence: Synthetic oligonucleotide
aaaucagugcauucccacgug

SEQ ID NO: 27909 - RNA, 21 nt, Artificial Sequence
  Description of Artificial Sequence: Synthetic oligonucleotide
aaaaucagugcauucccacgu

SEQ ID NO: 27910 - RNA, 21 nt, Artificial Sequence
  Description of Artificial Sequence: Synthetic oligonucleotide
aaaaaucagugcauucccacg

SEQ ID NO: 27911 - RNA, 21 nt, Artificial Sequence
  Description of Artificial Sequence: Synthetic oligonucleotide
gaaaaaucagugcauucccac

SEQ ID NO: 27912 - RNA, 21 nt, Artificial Sequence
  Description of Artificial Sequence: Synthetic oligonucleotide
ggaaaaaucagugcauuccca

SEQ ID NO: 27913 - RNA, 21 nt, Artificial Sequence
  Description of Artificial Sequence: Synthetic oligonucleotide
aggaaaaaucagugcauuccc

SEQ ID NO: 27914 - RNA, 21 nt, Artificial Sequence
  Description of Artificial Sequence: Synthetic oligonucleotide
uaggaaaaaucagugcauucc

SEQ ID NO: 27915 - RNA, 21 nt, Artificial Sequence
  Description of Artificial Sequence: Synthetic oligonucleotide
cuaggaaaaaucagugcauuc

SEQ ID NO: 27916 - RNA, 21 nt, Artificial Sequence
  Description of Artificial Sequence: Synthetic oligonucleotide
ccuaggaaaaaucagugcauu

SEQ ID NO: 27917 - RNA, 21 nt, Artificial Sequence
  Description of Artificial Sequence: Synthetic oligonucleotide
uccuaggaaaaaucagugcau

SEQ ID NO: 27918 - RNA, 21 nt, Artificial Sequence
  Description of Artificial Sequence: Synthetic oligonucleotide
cuccuaggaaaaaucagugca

SEQ ID NO: 27919 - RNA, 21 nt, Artificial Sequence
  Description of Artificial Sequence: Synthetic oligonucleotide
acuccuaggaaaaaucagugc

SEQ ID NO: 27920 - RNA, 21 nt, Artificial Sequence
  Description of Artificial Sequence: Synthetic oligonucleotide
uacuccuaggaaaaaucagug

SEQ ID NO: 27921 - RNA, 21 nt, Artificial Sequence
  Description of Artificial Sequence: Synthetic oligonucleotide
cuacuccuaggaaaaaucagu

SEQ ID NO: 27922 - RNA, 21 nt, Artificial Sequence
  Description of Artificial Sequence: Synthetic oligonucleotide
ucuacuccuaggaaaaaucag

SEQ ID NO: 27923 - RNA, 21 nt, Artificial Sequence
  Description of Artificial Sequence: Synthetic oligonucleotide
gucuacuccuaggaaaaauca

SEQ ID NO: 27924 - RNA, 21 nt, Artificial Sequence
  Description of Artificial Sequence: Synthetic oligonucleotide
ugucuacuccuaggaaaaauc

SEQ ID NO: 27925 - RNA, 21 nt, Artificial Sequence
  Description of Artificial Sequence: Synthetic oligonucleotide
augucuacuccuaggaaaaau

SEQ ID NO: 27926 - RNA, 21 nt, Artificial Sequence
  Description of Artificial Sequence: Synthetic oligonucleotide
caugucuacuccuaggaaaaa

SEQ ID NO: 27927 - RNA, 21 nt, Artificial Sequence
  Description of Artificial Sequence: Synthetic oligonucleotide
acaugucuacuccuaggaaaa

SEQ ID NO: 27928 - RNA, 21 nt, Artificial Sequence
  Description of Artificial Sequence: Synthetic oligonucleotide
aacaugucuacuccuaggaaa

SEQ ID NO: 27929 - RNA, 21 nt, Artificial Sequence
  Description of Artificial Sequence: Synthetic oligonucleotide
gaacaugucuacuccuaggaa

SEQ ID NO: 27930 - RNA, 21 nt, Artificial Sequence
  Description of Artificial Sequence: Synthetic oligonucleotide
ggaacaugucuacuccuagga

SEQ ID NO: 27931 - RNA, 21 nt, Artificial Sequence
  Description of Artificial Sequence: Synthetic oligonucleotide
aggaacaugucuacuccuagg

SEQ ID NO: 27932 - RNA, 21 nt, Artificial Sequence
  Description of Artificial Sequence: Synthetic oligonucleotide
gaggaacaugucuacuccuag

SEQ ID NO: 27933 - RNA, 21 nt, Artificial Sequence
  Description of Artificial Sequence: Synthetic oligonucleotide
agaggaacaugucuacuccua

SEQ ID NO: 27934 - RNA, 21 nt, Artificial Sequence
  Description of Artificial Sequence: Synthetic oligonucleotide
uagaggaacaugucuacuccu

SEQ ID NO: 27935 - RNA, 21 nt, Artificial Sequence
  Description of Artificial Sequence: Synthetic oligonucleotide
uuagaggaacaugucuacucc

SEQ ID NO: 27936 - RNA, 21 nt, Artificial Sequence
  Description of Artificial Sequence: Synthetic oligonucleotide
auuagaggaacaugucuacuc

SEQ ID NO: 27937 - RNA, 21 nt, Artificial Sequence
  Description of Artificial Sequence: Synthetic oligonucleotide
aauuagaggaacaugucuacu

SEQ ID NO: 27938 - RNA, 21 nt, Artificial Sequence
  Description of Artificial Sequence: Synthetic oligonucleotide
uaauuagaggaacaugucuac

SEQ ID NO: 27939 - RNA, 21 nt, Artificial Sequence
  Description of Artificial Sequence: Synthetic oligonucleotide
guaauuagaggaacaugucua

SEQ ID NO: 27940 - RNA, 21 nt, Artificial Sequence
  Description of Artificial Sequence: Synthetic oligonucleotide
aguaauuagaggaacaugucu

SEQ ID NO: 27941 - RNA, 21 nt, Artificial Sequence
  Description of Artificial Sequence: Synthetic oligonucleotide
gaguaauuagaggaacauguc

SEQ ID NO: 27942 - RNA, 21 nt, Artificial Sequence
  Description of Artificial Sequence: Synthetic oligonucleotide
ggaguaauuagaggaacaugu

SEQ ID NO: 27943 - RNA, 21 nt, Artificial Sequence
  Description of Artificial Sequence: Synthetic oligonucleotide
gggaguaauuagaggaacaug

SEQ ID NO: 27944 - RNA, 21 nt, Artificial Sequence
  Description of Artificial Sequence: Synthetic oligonucleotide
agggaguaauuagaggaacau

SEQ ID NO: 27945 - RNA, 21 nt, Artificial Sequence
  Description of Artificial Sequence: Synthetic oligonucleotide
cagggaguaauuagaggaaca

SEQ ID NO: 27946 - RNA, 21 nt, Artificial Sequence
  Description of Artificial Sequence: Synthetic oligonucleotide
ucagggaguaauuagaggaac

SEQ ID NO: 27947 - RNA, 21 nt, Artificial Sequence
  Description of Artificial Sequence: Synthetic oligonucleotide
cucagggaguaauuagaggaa

SEQ ID NO: 27948 - RNA, 21 nt, Artificial Sequence
  Description of Artificial Sequence: Synthetic oligonucleotide
ccucagggaguaauuagagga

SEQ ID NO: 27949 - RNA, 21 nt, Artificial Sequence
  Description of Artificial Sequence: Synthetic oligonucleotide
cccucagggaguaauuagagg

SEQ ID NO: 27950 - RNA, 21 nt, Artificial Sequence
  Description of Artificial Sequence: Synthetic oligonucleotide
acccucagggaguaauuagag

SEQ ID NO: 27951 - RNA, 21 nt, Artificial Sequence
  Description of Artificial Sequence: Synthetic oligonucleotide
aacccucagggaguaauuaga

SEQ ID NO: 27952 - RNA, 21 nt, Artificial Sequence
  Description of Artificial Sequence: Synthetic oligonucleotide
uaacccucagggaguaauuag

SEQ ID NO: 27953 - RNA, 21 nt, Artificial Sequence
  Description of Artificial Sequence: Synthetic oligonucleotide
cuaacccucagggaguaauua

SEQ ID NO: 27954 - RNA, 21 nt, Artificial Sequence
  Description of Artificial Sequence: Synthetic oligonucleotide
acuaacccucagggaguaauu

SEQ ID NO: 27955 - RNA, 21 nt, Artificial Sequence
  Description of Artificial Sequence: Synthetic oligonucleotide
aacuaacccucagggaguaau

SEQ ID NO: 27956 - RNA, 21 nt, Artificial Sequence
  Description of Artificial Sequence: Synthetic oligonucleotide
caacuaacccucagggaguaa

SEQ ID NO: 27957 - RNA, 21 nt, Artificial Sequence
  Description of Artificial Sequence: Synthetic oligonucleotide
ccaacuaacccucagggagua

SEQ ID NO: 27958 - RNA, 21 nt, Artificial Sequence
  Description of Artificial Sequence: Synthetic oligonucleotide
cccaacuaacccucagggagu

SEQ ID NO: 27959 - RNA, 21 nt, Artificial Sequence
  Description of Artificial Sequence: Synthetic oligonucleotide
ccccaacuaacccucagggag

SEQ ID NO: 27960 - RNA, 21 nt, Artificial Sequence
  Description of Artificial Sequence: Synthetic oligonucleotide
gccccaacuaacccucaggga

SEQ ID NO: 27961 - RNA, 21 nt, Artificial Sequence
  Description of Artificial Sequence: Synthetic oligonucleotide
agccccaacuaacccucaggg

SEQ ID NO: 27962 - RNA, 21 nt, Artificial Sequence
  Description of Artificial Sequence: Synthetic oligonucleotide
uagccccaacuaacccucagg

SEQ ID NO: 27963 - RNA, 21 nt, Artificial Sequence
  Description of Artificial Sequence: Synthetic oligonucleotide
uuagccccaacuaacccucag

SEQ ID NO: 27964 - RNA, 21 nt, Artificial Sequence
  Description of Artificial Sequence: Synthetic oligonucleotide
uuuagccccaacuaacccuca

SEQ ID NO: 27965 - RNA, 21 nt, Artificial Sequence
  Description of Artificial Sequence: Synthetic oligonucleotide
guuuagccccaacuaacccuc

SEQ ID NO: 27966 - RNA, 21 nt, Artificial Sequence
  Description of Artificial Sequence: Synthetic oligonucleotide
gguuuagccccaacuaacccu

SEQ ID NO: 27967 - RNA, 21 nt, Artificial Sequence
  Description of Artificial Sequence: Synthetic oligonucleotide
ugguuuagccccaacuaaccc

SEQ ID NO: 27968 - RNA, 21 nt, Artificial Sequence
  Description of Artificial Sequence: Synthetic oligonucleotide
augguuuagccccaacuaacc

SEQ ID NO: 27969 - RNA, 21 nt, Artificial Sequence
  Description of Artificial Sequence: Synthetic oligonucleotide
caugguuuagccccaacuaac

SEQ ID NO: 27970 - RNA, 21 nt, Artificial Sequence
  Description of Artificial Sequence: Synthetic oligonucleotide
ucaugguuuagccccaacuaa

SEQ ID NO: 27971 - RNA, 21 nt, Artificial Sequence
  Description of Artificial Sequence: Synthetic oligonucleotide
gucaugguuuagccccaacua

SEQ ID NO: 27972 - RNA, 21 nt, Artificial Sequence
  Description of Artificial Sequence: Synthetic oligonucleotide
ugucaugguuuagccccaacu

SEQ ID NO: 27973 - RNA, 21 nt, Artificial Sequence
  Description of Artificial Sequence: Synthetic oligonucleotide
cugucaugguuuagccccaac

SEQ ID NO: 27974 - RNA, 21 nt, Artificial Sequence
  Description of Artificial Sequence: Synthetic oligonucleotide
ucugucaugguuuagccccaa

SEQ ID NO: 27975 - RNA, 21 nt, Artificial Sequence
  Description of Artificial Sequence: Synthetic oligonucleotide
uucugucaugguuuagcccca

SEQ ID NO: 27976 - RNA, 21 nt, Artificial Sequence
  Description of Artificial Sequence: Synthetic oligonucleotide
cuucugucaugguuuagcccc

SEQ ID NO: 27977 - RNA, 21 nt, Artificial Sequence
  Description of Artificial Sequence: Synthetic oligonucleotide
acuucugucaugguuuagccc

SEQ ID NO: 27978 - RNA, 21 nt, Artificial Sequence
  Description of Artificial Sequence: Synthetic oligonucleotide
cacuucugucaugguuuagcc

SEQ ID NO: 27979 - RNA, 21 nt, Artificial Sequence
  Description of Artificial Sequence: Synthetic oligonucleotide
ccacuucugucaugguuuagc

SEQ ID NO: 27980 - RNA, 21 nt, Artificial Sequence
  Description of Artificial Sequence: Synthetic oligonucleotide
cccacuucugucaugguuuag

SEQ ID NO: 27981 - RNA, 21 nt, Artificial Sequence
  Description of Artificial Sequence: Synthetic oligonucleotide
ccccacuucugucaugguuua

SEQ ID NO: 27982 - RNA, 21 nt, Artificial Sequence
  Description of Artificial Sequence: Synthetic oligonucleotide
uccccacuucugucaugguuu

SEQ ID NO: 27983 - RNA, 21 nt, Artificial Sequence
  Description of Artificial Sequence: Synthetic oligonucleotide
uuccccacuucugucaugguu

SEQ ID NO: 27984 - RNA, 21 nt, Artificial Sequence
  Description of Artificial Sequence: Synthetic oligonucleotide
cuuccccacuucugucauggu

SEQ ID NO: 27985 - RNA, 21 nt, Artificial Sequence
  Description of Artificial Sequence: Synthetic oligonucleotide
acuuccccacuucugucaugg

SEQ ID NO: 27986 - RNA, 21 nt, Artificial Sequence
  Description of Artificial Sequence: Synthetic oligonucleotide
aacuuccccacuucugucaug

SEQ ID NO: 27987 - RNA, 21 nt, Artificial Sequence
  Description of Artificial Sequence: Synthetic oligonucleotide
gaacuuccccacuucugucau

SEQ ID NO: 27988 - RNA, 21 nt, Artificial Sequence
  Description of Artificial Sequence: Synthetic oligonucleotide
ugaacuuccccacuucuguca

SEQ ID NO: 27989 - RNA, 21 nt, Artificial Sequence
  Description of Artificial Sequence: Synthetic oligonucleotide
uugaacuuccccacuucuguc

SEQ ID NO: 27990 - RNA, 21 nt, Artificial Sequence
  Description of Artificial Sequence: Synthetic oligonucleotide
auugaacuuccccacuucugu

SEQ ID NO: 27991 - RNA, 21 nt, Artificial Sequence
  Description of Artificial Sequence: Synthetic oligonucleotide
cauugaacuuccccacuucug

SEQ ID NO: 27992 - RNA, 21 nt, Artificial Sequence
  Description of Artificial Sequence: Synthetic oligonucleotide
acauugaacuuccccacuucu

SEQ ID NO: 27993 - RNA, 21 nt, Artificial Sequence
  Description of Artificial Sequence: Synthetic oligonucleotide
gacauugaacuuccccacuuc

SEQ ID NO: 27994 - RNA, 21 nt, Artificial Sequence
  Description of Artificial Sequence: Synthetic oligonucleotide
ggacauugaacuuccccacuu

SEQ ID NO: 27995 - RNA, 21 nt, Artificial Sequence
  Description of Artificial Sequence: Synthetic oligonucleotide
aggacauugaacuuccccacu

SEQ ID NO: 27996 - RNA, 21 nt, Artificial Sequence
  Description of Artificial Sequence: Synthetic oligonucleotide
aaggacauugaacuuccccac

SEQ ID NO: 27997 - RNA, 21 nt, Artificial Sequence
  Description of Artificial Sequence: Synthetic oligonucleotide
uaaggacauugaacuucccca

SEQ ID NO: 27998 - RNA, 21 nt, Artificial Sequence
  Description of Artificial Sequence: Synthetic oligonucleotide
uuaaggacauugaacuucccc

SEQ ID NO: 27999 - RNA, 21 nt, Artificial Sequence
  Description of Artificial Sequence: Synthetic oligonucleotide
uuuaaggacauugaacuuccc

SEQ ID NO: 28000 - RNA, 21 nt, Artificial Sequence
  Description of Artificial Sequence: Synthetic oligonucleotide
auuuaaggacauugaacuucc

SEQ ID NO: 28001 - RNA, 21 nt, Artificial Sequence
  Description of Artificial Sequence: Synthetic oligonucleotide
gauuuaaggacauugaacuuc

SEQ ID NO: 28002 - RNA, 21 nt, Artificial Sequence
  Description of Artificial Sequence: Synthetic oligonucleotide
ggauuuaaggacauugaacuu

SEQ ID NO: 28003 - RNA, 21 nt, Artificial Sequence
  Description of Artificial Sequence: Synthetic oligonucleotide
uggauuuaaggacauugaacu

SEQ ID NO: 28004 - RNA, 21 nt, Artificial Sequence
  Description of Artificial Sequence: Synthetic oligonucleotide
auggauuuaaggacauugaac

SEQ ID NO: 28005 - RNA, 21 nt, Artificial Sequence
  Description of Artificial Sequence: Synthetic oligonucleotide
gauggauuuaaggacauugaa

SEQ ID NO: 28006 - RNA, 21 nt, Artificial Sequence
  Description of Artificial Sequence: Synthetic oligonucleotide
agauggauuuaaggacauuga

SEQ ID NO: 28007 - RNA, 21 nt, Artificial Sequence
  Description of Artificial Sequence: Synthetic oligonucleotide
aagauggauuuaaggacauug

SEQ ID NO: 28008 - RNA, 21 nt, Artificial Sequence
  Description of Artificial Sequence: Synthetic oligonucleotide
uaagauggauuuaaggacauu

SEQ ID NO: 28009 - RNA, 21 nt, Artificial Sequence
  Description of Artificial Sequence: Synthetic oligonucleotide
guaagauggauuuaaggacau

SEQ ID NO: 28010 - RNA, 21 nt, Artificial Sequence
  Description of Artificial Sequence: Synthetic oligonucleotide
aguaagauggauuuaaggaca

SEQ ID NO: 28011 - RNA, 21 nt, Artificial Sequence
  Description of Artificial Sequence: Synthetic oligonucleotide
aaguaagauggauuuaaggac

SEQ ID NO: 28012 - RNA, 21 nt, Artificial Sequence
  Description of Artificial Sequence: Synthetic oligonucleotide
caaguaagauggauuuaagga

SEQ ID NO: 28013 - RNA, 21 nt, Artificial Sequence
  Description of Artificial Sequence: Synthetic oligonucleotide
gcaaguaagauggauuuaagg

SEQ ID NO: 28014 - RNA, 21 nt, Artificial Sequence
  Description of Artificial Sequence: Synthetic oligonucleotide
ggcaaguaagauggauuuaag

SEQ ID NO: 28015 - RNA, 21 nt, Artificial Sequence
  Description of Artificial Sequence: Synthetic oligonucleotide
uggcaaguaagauggauuuaa

SEQ ID NO: 28016 - RNA, 21 nt, Artificial Sequence
  Description of Artificial Sequence: Synthetic oligonucleotide
uuggcaaguaagauggauuua

SEQ ID NO: 28017 - RNA, 21 nt, Artificial Sequence
  Description of Artificial Sequence: Synthetic oligonucleotide
guuggcaaguaagauggauuu

SEQ ID NO: 28018 - RNA, 21 nt, Artificial Sequence
  Description of Artificial Sequence: Synthetic oligonucleotide
uguuggcaaguaagauggauu

SEQ ID NO: 28019 - RNA, 21 nt, Artificial Sequence
  Description of Artificial Sequence: Synthetic oligonucleotide
cuguuggcaaguaagauggau

SEQ ID NO: 28020 - RNA, 21 nt, Artificial Sequence
  Description of Artificial Sequence: Synthetic oligonucleotide
ccuguuggcaaguaagaugga

SEQ ID NO: 28021 - RNA, 21 nt, Artificial Sequence
  Description of Artificial Sequence: Synthetic oligonucleotide
accuguuggcaaguaagaugg

SEQ ID NO: 28022 - RNA, 21 nt, Artificial Sequence
  Description of Artificial Sequence: Synthetic oligonucleotide
uaccuguuggcaaguaagaug

SEQ ID NO: 28023 - RNA, 21 nt, Artificial Sequence
  Description of Artificial Sequence: Synthetic oligonucleotide
uuaccuguuggcaaguaagau

SEQ ID NO: 28024 - RNA, 21 nt, Artificial Sequence
  Description of Artificial Sequence: Synthetic oligonucleotide
cuuaccuguuggcaaguaaga

SEQ ID NO: 28025 - RNA, 21 nt, Artificial Sequence
  Description of Artificial Sequence: Synthetic oligonucleotide
ucuuaccuguuggcaaguaag

SEQ ID NO: 28026 - RNA, 21 nt, Artificial Sequence
  Description of Artificial Sequence: Synthetic oligonucleotide
cucuuaccuguuggcaaguaa

SEQ ID NO: 28027 - RNA, 21 nt, Artificial Sequence
  Description of Artificial Sequence: Synthetic oligonucleotide
ccucuuaccuguuggcaagua

SEQ ID NO: 28028 - RNA, 21 nt, Artificial Sequence
  Description of Artificial Sequence: Synthetic oligonucleotide
uccucuuaccuguuggcaagu

SEQ ID NO: 28029 - RNA, 21 nt, Artificial Sequence
  Description of Artificial Sequence: Synthetic oligonucleotide
uuccucuuaccuguuggcaag

SEQ ID NO: 28030 - RNA, 21 nt, Artificial Sequence
  Description of Artificial Sequence: Synthetic oligonucleotide
cuuccucuuaccuguuggcaa

SEQ ID NO: 28031 - RNA, 21 nt, Artificial Sequence
  Description of Artificial Sequence: Synthetic oligonucleotide
gcuuccucuuaccuguuggca

SEQ ID NO: 28032 - RNA, 21 nt, Artificial Sequence
  Description of Artificial Sequence: Synthetic oligonucleotide
agcuuccucuuaccuguuggc

SEQ ID NO: 28033 - RNA, 21 nt, Artificial Sequence
  Description of Artificial Sequence: Synthetic oligonucleotide
aagcuuccucuuaccuguugg

SEQ ID NO: 28034 - RNA, 21 nt, Artificial Sequence
  Description of Artificial Sequence: Synthetic oligonucleotide
uaagcuuccucuuaccuguug

SEQ ID NO: 28035 - RNA, 21 nt, Artificial Sequence
  Description of Artificial Sequence: Synthetic oligonucleotide
guaagcuuccucuuaccuguu

SEQ ID NO: 28036 - RNA, 21 nt, Artificial Sequence
  Description of Artificial Sequence: Synthetic oligonucleotide
uguaagcuuccucuuaccugu

SEQ ID NO: 28037 - RNA, 21 nt, Artificial Sequence
  Description of Artificial Sequence: Synthetic oligonucleotide
auguaagcuuccucuuaccug

SEQ ID NO: 28038 - RNA, 21 nt, Artificial Sequence
  Description of Artificial Sequence: Synthetic oligonucleotide
aauguaagcuuccucuuaccu

SEQ ID NO: 28039 - RNA, 21 nt, Artificial Sequence
  Description of Artificial Sequence: Synthetic oligonucleotide
uaauguaagcuuccucuuacc

SEQ ID NO: 28040 - RNA, 21 nt, Artificial Sequence
  Description of Artificial Sequence: Synthetic oligonucleotide
guaauguaagcuuccucuuac

SEQ ID NO: 28041 - RNA, 21 nt, Artificial Sequence
  Description of Artificial Sequence: Synthetic oligonucleotide
uguaauguaagcuuccucuua

SEQ ID NO: 28042 - RNA, 21 nt, Artificial Sequence
  Description of Artificial Sequence: Synthetic oligonucleotide
auguaauguaagcuuccucuu

SEQ ID NO: 28043 - RNA, 21 nt, Artificial Sequence
  Description of Artificial Sequence: Synthetic oligonucleotide
cauguaauguaagcuuccucu

SEQ ID NO: 28044 - RNA, 21 nt, Artificial Sequence
  Description of Artificial Sequence: Synthetic oligonucleotide
acauguaauguaagcuuccuc

SEQ ID NO: 28045 - RNA, 21 nt, Artificial Sequence
  Description of Artificial Sequence: Synthetic oligonucleotide
gacauguaauguaagcuuccu

SEQ ID NO: 28046 - RNA, 21 nt, Artificial Sequence
  Description of Artificial Sequence: Synthetic oligonucleotide
ggacauguaauguaagcuucc

SEQ ID NO: 28047 - RNA, 21 nt, Artificial Sequence
  Description of Artificial Sequence: Synthetic oligonucleotide
uggacauguaauguaagcuuc

SEQ ID NO: 28048 - RNA, 21 nt, Artificial Sequence
  Description of Artificial Sequence: Synthetic oligonucleotide
cuggacauguaauguaagcuu

SEQ ID NO: 28049 - RNA, 21 nt, Artificial Sequence
  Description of Artificial Sequence: Synthetic oligonucleotide
acuggacauguaauguaagcu

SEQ ID NO: 28050 - RNA, 21 nt, Artificial Sequence
  Description of Artificial Sequence: Synthetic oligonucleotide
gacuggacauguaauguaagc

SEQ ID NO: 28051 - RNA, 21 nt, Artificial Sequence
  Description of Artificial Sequence: Synthetic oligonucleotide
ggacuggacauguaauguaag

SEQ ID NO: 28052 - RNA, 21 nt, Artificial Sequence
  Description of Artificial Sequence: Synthetic oligonucleotide
uggacuggacauguaauguaa

SEQ ID NO: 28053 - RNA, 21 nt, Artificial Sequence
  Description of Artificial Sequence: Synthetic oligonucleotide
guggacuggacauguaaugua

SEQ ID NO: 28054 - RNA, 21 nt, Artificial Sequence
  Description of Artificial Sequence: Synthetic oligonucleotide
uguggacuggacauguaaugu

SEQ ID NO: 28055 - RNA, 21 nt, Artificial Sequence
  Description of Artificial Sequence: Synthetic oligonucleotide
auguggacuggacauguaaug

SEQ ID NO: 28056 - RNA, 21 nt, Artificial Sequence
  Description of Artificial Sequence: Synthetic oligonucleotide
aauguggacuggacauguaau

SEQ ID NO: 28057 - RNA, 21 nt, Artificial Sequence
  Description of Artificial Sequence: Synthetic oligonucleotide
aaauguggacuggacauguaa

SEQ ID NO: 28058 - RNA, 21 nt, Artificial Sequence
  Description of Artificial Sequence: Synthetic oligonucleotide
uaaauguggacuggacaugua

SEQ ID NO: 28059 - RNA, 21 nt, Artificial Sequence
  Description of Artificial Sequence: Synthetic oligonucleotide
uuaaauguggacuggacaugu

SEQ ID NO: 28060 - RNA, 21 nt, Artificial Sequence
  Description of Artificial Sequence: Synthetic oligonucleotide
uuuaaauguggacuggacaug

SEQ ID NO: 28061 - RNA, 21 nt, Artificial Sequence
  Description of Artificial Sequence: Synthetic oligonucleotide
cuuuaaauguggacuggacau

SEQ ID NO: 28062 - RNA, 21 nt, Artificial Sequence
  Description of Artificial Sequence: Synthetic oligonucleotide
ucuuuaaauguggacuggaca

SEQ ID NO: 28063 - RNA, 21 nt, Artificial Sequence
  Description of Artificial Sequence: Synthetic oligonucleotide
cucuuuaaauguggacuggac

SEQ ID NO: 28064 - RNA, 21 nt, Artificial Sequence
  Description of Artificial Sequence: Synthetic oligonucleotide
gcucuuuaaauguggacugga

SEQ ID NO: 28065 - RNA, 21 nt, Artificial Sequence
  Description of Artificial Sequence: Synthetic oligonucleotide
ugcucuuuaaauguggacugg

SEQ ID NO: 28066 - RNA, 21 nt, Artificial Sequence
  Description of Artificial Sequence: Synthetic oligonucleotide
gugcucuuuaaauguggacug

SEQ ID NO: 28067 - RNA, 21 nt, Artificial Sequence
  Description of Artificial Sequence: Synthetic oligonucleotide
agugcucuuuaaauguggacu

SEQ ID NO: 28068 - RNA, 21 nt, Artificial Sequence
  Description of Artificial Sequence: Synthetic oligonucleotide
aagugcucuuuaaauguggac

SEQ ID NO: 28069 - RNA, 21 nt, Artificial Sequence
  Description of Artificial Sequence: Synthetic oligonucleotide
uaagugcucuuuaaaugugga

SEQ ID NO: 28070 - RNA, 21 nt, Artificial Sequence
  Description of Artificial Sequence: Synthetic oligonucleotide
guaagugcucuuuaaaugugg

SEQ ID NO: 28071 - RNA, 21 nt, Artificial Sequence
  Description of Artificial Sequence: Synthetic oligonucleotide
aguaagugcucuuuaaaugug

SEQ ID NO: 28072 - RNA, 21 nt, Artificial Sequence
  Description of Artificial Sequence: Synthetic oligonucleotide
caguaagugcucuuuaaaugu

SEQ ID NO: 28073 - RNA, 21 nt, Artificial Sequence
  Description of Artificial Sequence: Synthetic oligonucleotide
acaguaagugcucuuuaaaug

SEQ ID NO: 28074 - RNA, 21 nt, Artificial Sequence
  Description of Artificial Sequence: Synthetic oligonucleotide
cacaguaagugcucuuuaaau

SEQ ID NO: 28075 - RNA, 21 nt, Artificial Sequence
  Description of Artificial Sequence: Synthetic oligonucleotide
ccacaguaagugcucuuuaaa

SEQ ID NO: 28076 - RNA, 21 nt, Artificial Sequence
  Description of Artificial Sequence: Synthetic oligonucleotide
uccacaguaagugcucuuuaa

SEQ ID NO: 28077 - RNA, 21 nt, Artificial Sequence
  Description of Artificial Sequence: Synthetic oligonucleotide
uuccacaguaagugcucuuua

SEQ ID NO: 28078 - RNA, 21 nt, Artificial Sequence
  Description of Artificial Sequence: Synthetic oligonucleotide
guuccacaguaagugcucuuu

SEQ ID NO: 28079 - RNA, 21 nt, Artificial Sequence
  Description of Artificial Sequence: Synthetic oligonucleotide
uguuccacaguaagugcucuu

SEQ ID NO: 28080 - RNA, 21 nt, Artificial Sequence
  Description of Artificial Sequence: Synthetic oligonucleotide
uuguuccacaguaagugcucu

SEQ ID NO: 28081 - RNA, 21 nt, Artificial Sequence
  Description of Artificial Sequence: Synthetic oligonucleotide
cuuguuccacaguaagugcuc

SEQ ID NO: 28082 - RNA, 21 nt, Artificial Sequence
  Description of Artificial Sequence: Synthetic oligonucleotide
gcuuguuccacaguaagugcu

SEQ ID NO: 28083 - RNA, 21 nt, Artificial Sequence
  Description of Artificial Sequence: Synthetic oligonucleotide
ggcuuguuccacaguaagugc

SEQ ID NO: 28084 - RNA, 21 nt, Artificial Sequence
  Description of Artificial Sequence: Synthetic oligonucleotide
aggcuuguuccacaguaagug

SEQ ID NO: 28085 - RNA, 21 nt, Artificial Sequence
  Description of Artificial Sequence: Synthetic oligonucleotide
aaggcuuguuccacaguaagu

SEQ ID NO: 28086 - RNA, 21 nt, Artificial Sequence
  Description of Artificial Sequence: Synthetic oligonucleotide
gaaggcuuguuccacaguaag

SEQ ID NO: 28087 - RNA, 21 nt, Artificial Sequence
  Description of Artificial Sequence: Synthetic oligonucleotide
ugaaggcuuguuccacaguaa

SEQ ID NO: 28088 - RNA, 21 nt, Artificial Sequence
  Description of Artificial Sequence: Synthetic oligonucleotide
cugaaggcuuguuccacagua

SEQ ID NO: 28089 - RNA, 21 nt, Artificial Sequence
  Description of Artificial Sequence: Synthetic oligonucleotide
gcugaaggcuuguuccacagu

SEQ ID NO: 28090 - RNA, 21 nt, Artificial Sequence
  Description of Artificial Sequence: Synthetic oligonucleotide
ggcugaaggcuuguuccacag

SEQ ID NO: 28091 - RNA, 21 nt, Artificial Sequence
  Description of Artificial Sequence: Synthetic oligonucleotide
uggcugaaggcuuguuccaca

SEQ ID NO: 28092 - RNA, 21 nt, Artificial Sequence
  Description of Artificial Sequence: Synthetic oligonucleotide
uuggcugaaggcuuguuccac

SEQ ID NO: 28093 - RNA, 21 nt, Artificial Sequence
  Description of Artificial Sequence: Synthetic oligonucleotide
uuuggcugaaggcuuguucca

SEQ ID NO: 28094 - RNA, 21 nt, Artificial Sequence
  Description of Artificial Sequence: Synthetic oligonucleotide
guuuggcugaaggcuuguucc

SEQ ID NO: 28095 - RNA, 21 nt, Artificial Sequence
  Description of Artificial Sequence: Synthetic oligonucleotide
uguuuggcugaaggcuuguuc

SEQ ID NO: 28096 - RNA, 21 nt, Artificial Sequence
  Description of Artificial Sequence: Synthetic oligonucleotide
uuguuuggcugaaggcuuguu

SEQ ID NO: 28097 - RNA, 21 nt, Artificial Sequence
  Description of Artificial Sequence: Synthetic oligonucleotide
auuguuuggcugaaggcuugu

SEQ ID NO: 28098 - RNA, 21 nt, Artificial Sequence
  Description of Artificial Sequence: Synthetic oligonucleotide
cauuguuuggcugaaggcuug

SEQ ID NO: 28099 - RNA, 21 nt, Artificial Sequence
  Description of Artificial Sequence: Synthetic oligonucleotide
ccauuguuuggcugaaggcuu

SEQ ID NO: 28100 - RNA, 21 nt, Artificial Sequence
  Description of Artificial Sequence: Synthetic oligonucleotide
cccauuguuuggcugaaggcu

SEQ ID NO: 28101 - RNA, 21 nt, Artificial Sequence
  Description of Artificial Sequence: Synthetic oligonucleotide
ccccauuguuuggcugaaggc

SEQ ID NO: 28102 - RNA, 21 nt, Artificial Sequence
  Description of Artificial Sequence: Synthetic oligonucleotide
uccccauuguuuggcugaagg

SEQ ID NO: 28103 - RNA, 21 nt, Artificial Sequence
  Description of Artificial Sequence: Synthetic oligonucleotide
auccccauuguuuggcugaag

SEQ ID NO: 28104 - RNA, 21 nt, Artificial Sequence
  Description of Artificial Sequence: Synthetic oligonucleotide
uauccccauuguuuggcugaa

SEQ ID NO: 28105 - RNA, 21 nt, Artificial Sequence
  Description of Artificial Sequence: Synthetic oligonucleotide
cuauccccauuguuuggcuga

SEQ ID NO: 28106 - RNA, 21 nt, Artificial Sequence
  Description of Artificial Sequence: Synthetic oligonucleotide
ucuauccccauuguuuggcug

SEQ ID NO: 28107 - RNA, 21 nt, Artificial Sequence
  Description of Artificial Sequence: Synthetic oligonucleotide
uucuauccccauuguuuggcu

SEQ ID NO: 28108 - RNA, 21 nt, Artificial Sequence
  Description of Artificial Sequence: Synthetic oligonucleotide
uuucuauccccauuguuuggc

SEQ ID NO: 28109 - RNA, 21 nt, Artificial Sequence
  Description of Artificial Sequence: Synthetic oligonucleotide
uuuucuauccccauuguuugg

SEQ ID NO: 28110 - RNA, 21 nt, Artificial Sequence
  Description of Artificial Sequence: Synthetic oligonucleotide
cuuuucuauccccauuguuug

SEQ ID NO: 28111 - RNA, 21 nt, Artificial Sequence
  Description of Artificial Sequence: Synthetic oligonucleotide
acuuuucuauccccauuguuu

SEQ ID NO: 28112 - RNA, 21 nt, Artificial Sequence
  Description of Artificial Sequence: Synthetic oligonucleotide
uacuuuucuauccccauuguu

SEQ ID NO: 28113 - RNA, 21 nt, Artificial Sequence
  Description of Artificial Sequence: Synthetic oligonucleotide
cuacuuuucuauccccauugu

SEQ ID NO: 28114 - RNA, 21 nt, Artificial Sequence
  Description of Artificial Sequence: Synthetic oligonucleotide
ccuacuuuucuauccccauug

SEQ ID NO: 28115 - RNA, 21 nt, Artificial Sequence
  Description of Artificial Sequence: Synthetic oligonucleotide
accuacuuuucuauccccauu

SEQ ID NO: 28116 - RNA, 21 nt, Artificial Sequence
  Description of Artificial Sequence: Synthetic oligonucleotide
uaccuacuuuucuauccccau

SEQ ID NO: 28117 - RNA, 21 nt, Artificial Sequence
  Description of Artificial Sequence: Synthetic oligonucleotide
uuaccuacuuuucuaucccca

SEQ ID NO: 28118 - RNA, 21 nt, Artificial Sequence
  Description of Artificial Sequence: Synthetic oligonucleotide
cuuaccuacuuuucuaucccc

SEQ ID NO: 28119 - RNA, 21 nt, Artificial Sequence
  Description of Artificial Sequence: Synthetic oligonucleotide
ucuuaccuacuuuucuauccc

SEQ ID NO: 28120 - RNA, 21 nt, Artificial Sequence
  Description of Artificial Sequence: Synthetic oligonucleotide
gucuuaccuacuuuucuaucc

SEQ ID NO: 28121 - RNA, 21 nt, Artificial Sequence
  Description of Artificial Sequence: Synthetic oligonucleotide
agucuuaccuacuuuucuauc

SEQ ID NO: 28122 - RNA, 21 nt, Artificial Sequence
  Description of Artificial Sequence: Synthetic oligonucleotide
gagucuuaccuacuuuucuau

SEQ ID NO: 28123 - RNA, 21 nt, Artificial Sequence
  Description of Artificial Sequence: Synthetic oligonucleotide
ugagucuuaccuacuuuucua

SEQ ID NO: 28124 - RNA, 21 nt, Artificial Sequence
  Description of Artificial Sequence: Synthetic oligonucleotide
cugagucuuaccuacuuuucu

SEQ ID NO: 28125 - RNA, 21 nt, Artificial Sequence
  Description of Artificial Sequence: Synthetic oligonucleotide
gcugagucuuaccuacuuuuc

SEQ ID NO: 28126 - RNA, 21 nt, Artificial Sequence
  Description of Artificial Sequence: Synthetic oligonucleotide
ggcugagucuuaccuacuuuu

SEQ ID NO: 28127 - RNA, 21 nt, Artificial Sequence
  Description of Artificial Sequence: Synthetic oligonucleotide
aggcugagucuuaccuacuuu

SEQ ID NO: 28128 - RNA, 21 nt, Artificial Sequence
  Description of Artificial Sequence: Synthetic oligonucleotide
aaggcugagucuuaccuacuu

SEQ ID NO: 28129 - RNA, 21 nt, Artificial Sequence
  Description of Artificial Sequence: Synthetic oligonucleotide
aaaggcugagucuuaccuacu

SEQ ID NO: 28130 - RNA, 21 nt, Artificial Sequence
  Description of Artificial Sequence: Synthetic oligonucleotide
caaaggcugagucuuaccuac

SEQ ID NO: 28131 - RNA, 21 nt, Artificial Sequence
  Description of Artificial Sequence: Synthetic oligonucleotide
acaaaggcugagucuuaccua

SEQ ID NO: 28132 - RNA, 21 nt, Artificial Sequence
  Description of Artificial Sequence: Synthetic oligonucleotide
gacaaaggcugagucuuaccu

SEQ ID NO: 28133 - RNA, 21 nt, Artificial Sequence
  Description of Artificial Sequence: Synthetic oligonucleotide
ggacaaaggcugagucuuacc

SEQ ID NO: 28134 - RNA, 21 nt, Artificial Sequence
  Description of Artificial Sequence: Synthetic oligonucleotide
uggacaaaggcugagucuuac

SEQ ID NO: 28135 - RNA, 21 nt, Artificial Sequence
  Description of Artificial Sequence: Synthetic oligonucleotide
cuggacaaaggcugagucuua

SEQ ID NO: 28136 - RNA, 21 nt, Artificial Sequence
  Description of Artificial Sequence: Synthetic oligonucleotide
ucuggacaaaggcugagucuu

SEQ ID NO: 28137 - RNA, 21 nt, Artificial Sequence
  Description of Artificial Sequence: Synthetic oligonucleotide
cucuggacaaaggcugagucu

SEQ ID NO: 28138 - RNA, 21 nt, Artificial Sequence
  Description of Artificial Sequence: Synthetic oligonucleotide
ucucuggacaaaggcugaguc

SEQ ID NO: 28139 - RNA, 21 nt, Artificial Sequence
  Description of Artificial Sequence: Synthetic oligonucleotide
uucucuggacaaaggcugagu

SEQ ID NO: 28140 - RNA, 21 nt, Artificial Sequence
  Description of Artificial Sequence: Synthetic oligonucleotide
cuucucuggacaaaggcugag

SEQ ID NO: 28141 - RNA, 21 nt, Artificial Sequence
  Description of Artificial Sequence: Synthetic oligonucleotide
gcuucucuggacaaaggcuga

SEQ ID NO: 28142 - RNA, 21 nt, Artificial Sequence
  Description of Artificial Sequence: Synthetic oligonucleotide
agcuucucuggacaaaggcug

SEQ ID NO: 28143 - RNA, 21 nt, Artificial Sequence
  Description of Artificial Sequence: Synthetic oligonucleotide
gagcuucucuggacaaaggcu

SEQ ID NO: 28144 - RNA, 21 nt, Artificial Sequence
  Description of Artificial Sequence: Synthetic oligonucleotide
ugagcuucucuggacaaaggc

SEQ ID NO: 28145 - RNA, 21 nt, Artificial Sequence
  Description of Artificial Sequence: Synthetic oligonucleotide
cugagcuucucuggacaaagg

SEQ ID NO: 28146 - RNA, 21 nt, Artificial Sequence
  Description of Artificial Sequence: Synthetic oligonucleotide
ccugagcuucucuggacaaag

SEQ ID NO: 28147 - RNA, 21 nt, Artificial Sequence
  Description of Artificial Sequence: Synthetic oligonucleotide
cccugagcuucucuggacaaa

SEQ ID NO: 28148 - RNA, 21 nt, Artificial Sequence
  Description of Artificial Sequence: Synthetic oligonucleotide
acccugagcuucucuggacaa

SEQ ID NO: 28149 - RNA, 21 nt, Artificial Sequence
  Description of Artificial Sequence: Synthetic oligonucleotide
uacccugagcuucucuggaca

SEQ ID NO: 28150 - RNA, 21 nt, Artificial Sequence
  Description of Artificial Sequence: Synthetic oligonucleotide
auacccugagcuucucuggac

SEQ ID NO: 28151 - RNA, 21 nt, Artificial Sequence
  Description of Artificial Sequence: Synthetic oligonucleotide
uauacccugagcuucucugga

SEQ ID NO: 28152 - RNA, 21 nt, Artificial Sequence
  Description of Artificial Sequence: Synthetic oligonucleotide
cuauacccugagcuucucugg

SEQ ID NO: 28153 - RNA, 21 nt, Artificial Sequence
  Description of Artificial Sequence: Synthetic oligonucleotide
gcuauacccugagcuucucug

SEQ ID NO: 28154 - RNA, 21 nt, Artificial Sequence
  Description of Artificial Sequence: Synthetic oligonucleotide
agcuauacccugagcuucucu

SEQ ID NO: 28155 - RNA, 21 nt, Artificial Sequence
  Description of Artificial Sequence: Synthetic oligonucleotide
cagcuauacccugagcuucuc

SEQ ID NO: 28156 - RNA, 21 nt, Artificial Sequence
  Description of Artificial Sequence: Synthetic oligonucleotide
ucagcuauacccugagcuucu

SEQ ID NO: 28157 - RNA, 21 nt, Artificial Sequence
  Description of Artificial Sequence: Synthetic oligonucleotide
uucagcuauacccugagcuuc

SEQ ID NO: 28158 - RNA, 21 nt, Artificial Sequence
  Description of Artificial Sequence: Synthetic oligonucleotide
auucagcuauacccugagcuu

SEQ ID NO: 28159 - RNA, 21 nt, Artificial Sequence
  Description of Artificial Sequence: Synthetic oligonucleotide
uauucagcuauacccugagcu

SEQ ID NO: 28160 - RNA, 21 nt, Artificial Sequence
  Description of Artificial Sequence: Synthetic oligonucleotide
cuauucagcuauacccugagc

SEQ ID NO: 28161 - RNA, 21 nt, Artificial Sequence
  Description of Artificial Sequence: Synthetic oligonucleotide
ccuauucagcuauacccugag

SEQ ID NO: 28162 - RNA, 21 nt, Artificial Sequence
  Description of Artificial Sequence: Synthetic oligonucleotide
gccuauucagcuauacccuga

SEQ ID NO: 28163 - RNA, 21 nt, Artificial Sequence
  Description of Artificial Sequence: Synthetic oligonucleotide
ugccuauucagcuauacccug

SEQ ID NO: 28164 - RNA, 21 nt, Artificial Sequence
  Description of Artificial Sequence: Synthetic oligonucleotide
cugccuauucagcuauacccu

SEQ ID NO: 28165 - RNA, 21 nt, Artificial Sequence
  Description of Artificial Sequence: Synthetic oligonucleotide
acugccuauucagcuauaccc

SEQ ID NO: 28166 - RNA, 21 nt, Artificial Sequence
  Description of Artificial Sequence: Synthetic oligonucleotide
aacugccuauucagcuauacc

SEQ ID NO: 28167 - RNA, 21 nt, Artificial Sequence
  Description of Artificial Sequence: Synthetic oligonucleotide
aaacugccuauucagcuauac

SEQ ID NO: 28168 - RNA, 21 nt, Artificial Sequence
  Description of Artificial Sequence: Synthetic oligonucleotide
gaaacugccuauucagcuaua

SEQ ID NO: 28169 - RNA, 21 nt, Artificial Sequence
  Description of Artificial Sequence: Synthetic oligonucleotide
agaaacugccuauucagcuau

SEQ ID NO: 28170 - RNA, 21 nt, Artificial Sequence
  Description of Artificial Sequence: Synthetic oligonucleotide
aagaaacugccuauucagcua

SEQ ID NO: 28171 - RNA, 21 nt, Artificial Sequence
  Description of Artificial Sequence: Synthetic oligonucleotide
aaagaaacugccuauucagcu

SEQ ID NO: 28172 - RNA, 21 nt, Artificial Sequence
  Description of Artificial Sequence: Synthetic oligonucleotide
aaaagaaacugccuauucagc

SEQ ID NO: 28173 - RNA, 21 nt, Artificial Sequence
  Description of Artificial Sequence: Synthetic oligonucleotide
caaaagaaacugccuauucag

SEQ ID NO: 28174 - RNA, 21 nt, Artificial Sequence
  Description of Artificial Sequence: Synthetic oligonucleotide
acaaaagaaacugccuauuca

SEQ ID NO: 28175 - RNA, 21 nt, Artificial Sequence
  Description of Artificial Sequence: Synthetic oligonucleotide
gacaaaagaaacugccuauuc

SEQ ID NO: 28176 - RNA, 21 nt, Artificial Sequence
  Description of Artificial Sequence: Synthetic oligonucleotide
ggacaaaagaaacugccuauu

SEQ ID NO: 28177 - RNA, 21 nt, Artificial Sequence
  Description of Artificial Sequence: Synthetic oligonucleotide
aggacaaaagaaacugccuau

SEQ ID NO: 28178 - RNA, 21 nt, Artificial Sequence
  Description of Artificial Sequence: Synthetic oligonucleotide
caggacaaaagaaacugccua

SEQ ID NO: 28179 - RNA, 21 nt, Artificial Sequence
  Description of Artificial Sequence: Synthetic oligonucleotide
ucaggacaaaagaaacugccu

SEQ ID NO: 28180 - RNA, 21 nt, Artificial Sequence
  Description of Artificial Sequence: Synthetic oligonucleotide
cucaggacaaaagaaacugcc

SEQ ID NO: 28181 - RNA, 21 nt, Artificial Sequence
  Description of Artificial Sequence: Synthetic oligonucleotide
ccucaggacaaaagaaacugc

SEQ ID NO: 28182 - RNA, 21 nt, Artificial Sequence
  Description of Artificial Sequence: Synthetic oligonucleotide
uccucaggacaaaagaaacug

SEQ ID NO: 28183 - RNA, 21 nt, Artificial Sequence
  Description of Artificial Sequence: Synthetic oligonucleotide
uuccucaggacaaaagaaacu

SEQ ID NO: 28184 - RNA, 21 nt, Artificial Sequence
  Description of Artificial Sequence: Synthetic oligonucleotide
uuuccucaggacaaaagaaac

SEQ ID NO: 28185 - RNA, 21 nt, Artificial Sequence
  Description of Artificial Sequence: Synthetic oligonucleotide
uuuuccucaggacaaaagaaa

SEQ ID NO: 28186 - RNA, 21 nt, Artificial Sequence
  Description of Artificial Sequence: Synthetic oligonucleotide
auuuuccucaggacaaaagaa

SEQ ID NO: 28187 - RNA, 21 nt, Artificial Sequence
  Description of Artificial Sequence: Synthetic oligonucleotide
gauuuuccucaggacaaaaga

SEQ ID NO: 28188 - RNA, 21 nt, Artificial Sequence
  Description of Artificial Sequence: Synthetic oligonucleotide
ugauuuuccucaggacaaaag

SEQ ID NO: 28189 - RNA, 21 nt, Artificial Sequence
  Description of Artificial Sequence: Synthetic oligonucleotide
cugauuuuccucaggacaaaa

SEQ ID NO: 28190 - RNA, 21 nt, Artificial Sequence
  Description of Artificial Sequence: Synthetic oligonucleotide
ccugauuuuccucaggacaaa

SEQ ID NO: 28191 - RNA, 21 nt, Artificial Sequence
  Description of Artificial Sequence: Synthetic oligonucleotide
uccugauuuuccucaggacaa

SEQ ID NO: 28192 - RNA, 21 nt, Artificial Sequence
  Description of Artificial Sequence: Synthetic oligonucleotide
guccugauuuuccucaggaca

SEQ ID NO: 28193 - RNA, 21 nt, Artificial Sequence
  Description of Artificial Sequence: Synthetic oligonucleotide
uguccugauuuuccucaggac

SEQ ID NO: 28194 - RNA, 21 nt, Artificial Sequence
  Description of Artificial Sequence: Synthetic oligonucleotide
auguccugauuuuccucagga

SEQ ID NO: 28195 - RNA, 21 nt, Artificial Sequence
  Description of Artificial Sequence: Synthetic oligonucleotide
cauguccugauuuuccucagg

SEQ ID NO: 28196 - RNA, 21 nt, Artificial Sequence
  Description of Artificial Sequence: Synthetic oligonucleotide
gcauguccugauuuuccucag

SEQ ID NO: 28197 - RNA, 21 nt, Artificial Sequence
  Description of Artificial Sequence: Synthetic oligonucleotide
ggcauguccugauuuuccuca

SEQ ID NO: 28198 - RNA, 21 nt, Artificial Sequence
  Description of Artificial Sequence: Synthetic oligonucleotide
aggcauguccugauuuuccuc

SEQ ID NO: 28199 - RNA, 21 nt, Artificial Sequence
  Description of Artificial Sequence: Synthetic oligonucleotide
caggcauguccugauuuuccu

SEQ ID NO: 28200 - RNA, 21 nt, Artificial Sequence
  Description of Artificial Sequence: Synthetic oligonucleotide
gcaggcauguccugauuuucc

SEQ ID NO: 28201 - RNA, 21 nt, Artificial Sequence
  Description of Artificial Sequence: Synthetic oligonucleotide
agcaggcauguccugauuuuc

SEQ ID NO: 28202 - RNA, 21 nt, Artificial Sequence
  Description of Artificial Sequence: Synthetic oligonucleotide
aagcaggcauguccugauuuu

SEQ ID NO: 28203 - RNA, 21 nt, Artificial Sequence
  Description of Artificial Sequence: Synthetic oligonucleotide
aaagcaggcauguccugauuu

SEQ ID NO: 28204 - RNA, 21 nt, Artificial Sequence
  Description of Artificial Sequence: Synthetic oligonucleotide
gaaagcaggcauguccugauu

SEQ ID NO: 28205 - RNA, 21 nt, Artificial Sequence
  Description of Artificial Sequence: Synthetic oligonucleotide
agaaagcaggcauguccugau

SEQ ID NO: 28206 - RNA, 21 nt, Artificial Sequence
  Description of Artificial Sequence: Synthetic oligonucleotide
uagaaagcaggcauguccuga

SEQ ID NO: 28207 - RNA, 21 nt, Artificial Sequence
  Description of Artificial Sequence: Synthetic oligonucleotide
uuagaaagcaggcauguccug

SEQ ID NO: 28208 - RNA, 21 nt, Artificial Sequence
  Description of Artificial Sequence: Synthetic oligonucleotide
uuuagaaagcaggcauguccu

SEQ ID NO: 28209 - RNA, 21 nt, Artificial Sequence
  Description of Artificial Sequence: Synthetic oligonucleotide
uuuuagaaagcaggcaugucc

SEQ ID NO: 28210 - RNA, 21 nt, Artificial Sequence
  Description of Artificial Sequence: Synthetic oligonucleotide
uuuuuagaaagcaggcauguc

SEQ ID NO: 28211 - RNA, 21 nt, Artificial Sequence
  Description of Artificial Sequence: Synthetic oligonucleotide
auuuuuagaaagcaggcaugu

SEQ ID NO: 28212 - RNA, 21 nt, Artificial Sequence
  Description of Artificial Sequence: Synthetic oligonucleotide
gauuuuuagaaagcaggcaug

SEQ ID NO: 28213 - RNA, 21 nt, Artificial Sequence
  Description of Artificial Sequence: Synthetic oligonucleotide
agauuuuuagaaagcaggcau

SEQ ID NO: 28214 - RNA, 21 nt, Artificial Sequence
  Description of Artificial Sequence: Synthetic oligonucleotide
aagauuuuuagaaagcaggca

SEQ ID NO: 28215 - RNA, 21 nt, Artificial Sequence
  Description of Artificial Sequence: Synthetic oligonucleotide
gaagauuuuuagaaagcaggc

SEQ ID NO: 28216 - RNA, 21 nt, Artificial Sequence
  Description of Artificial Sequence: Synthetic oligonucleotide
ggaagauuuuuagaaagcagg

SEQ ID NO: 28217 - RNA, 21 nt, Artificial Sequence
  Description of Artificial Sequence: Synthetic oligonucleotide
aggaagauuuuuagaaagcag

SEQ ID NO: 28218 - RNA, 21 nt, Artificial Sequence
  Description of Artificial Sequence: Synthetic oligonucleotide
gaggaagauuuuuagaaagca

SEQ ID NO: 28219 - RNA, 21 nt, Artificial Sequence
  Description of Artificial Sequence: Synthetic oligonucleotide
agaggaagauuuuuagaaagc

SEQ ID NO: 28220 - RNA, 21 nt, Artificial Sequence
  Description of Artificial Sequence: Synthetic oligonucleotide
cagaggaagauuuuuagaaag

SEQ ID NO: 28221 - RNA, 21 nt, Artificial Sequence
  Description of Artificial Sequence: Synthetic oligonucleotide
ucagaggaagauuuuuagaaa

SEQ ID NO: 28222 - RNA, 21 nt, Artificial Sequence
  Description of Artificial Sequence: Synthetic oligonucleotide
uucagaggaagauuuuuagaa

SEQ ID NO: 28223 - RNA, 21 nt, Artificial Sequence
  Description of Artificial Sequence: Synthetic oligonucleotide
cuucagaggaagauuuuuaga

SEQ ID NO: 28224 - RNA, 21 nt, Artificial Sequence
  Description of Artificial Sequence: Synthetic oligonucleotide
ucuucagaggaagauuuuuag

SEQ ID NO: 28225 - RNA, 21 nt, Artificial Sequence
  Description of Artificial Sequence: Synthetic oligonucleotide
gucuucagaggaagauuuuua

SEQ ID NO: 28226 - RNA, 21 nt, Artificial Sequence
  Description of Artificial Sequence: Synthetic oligonucleotide
ggucuucagaggaagauuuuu

SEQ ID NO: 28227 - RNA, 21 nt, Artificial Sequence
  Description of Artificial Sequence: Synthetic oligonucleotide
aggucuucagaggaagauuuu

SEQ ID NO: 28228 - RNA, 21 nt, Artificial Sequence
  Description of Artificial Sequence: Synthetic oligonucleotide
caggucuucagaggaagauuu

SEQ ID NO: 28229 - RNA, 21 nt, Artificial Sequence
  Description of Artificial Sequence: Synthetic oligonucleotide
ucaggucuucagaggaagauu

SEQ ID NO: 28230 - RNA, 21 nt, Artificial Sequence
  Description of Artificial Sequence: Synthetic oligonucleotide
gucaggucuucagaggaagau

SEQ ID NO: 28231 - RNA, 21 nt, Artificial Sequence
  Description of Artificial Sequence: Synthetic oligonucleotide
ggucaggucuucagaggaaga

SEQ ID NO: 28232 - RNA, 21 nt, Artificial Sequence
  Description of Artificial Sequence: Synthetic oligonucleotide
gggucaggucuucagaggaag

SEQ ID NO: 28233 - RNA, 21 nt, Artificial Sequence
  Description of Artificial Sequence: Synthetic oligonucleotide
ugggucaggucuucagaggaa

SEQ ID NO: 28234 - RNA, 21 nt, Artificial Sequence
  Description of Artificial Sequence: Synthetic oligonucleotide
uugggucaggucuucagagga

SEQ ID NO: 28235 - RNA, 21 nt, Artificial Sequence
  Description of Artificial Sequence: Synthetic oligonucleotide
cuugggucaggucuucagagg

SEQ ID NO: 28236 - RNA, 21 nt, Artificial Sequence
  Description of Artificial Sequence: Synthetic oligonucleotide
gcuugggucaggucuucagag

SEQ ID NO: 28237 - RNA, 21 nt, Artificial Sequence
  Description of Artificial Sequence: Synthetic oligonucleotide
agcuugggucaggucuucaga

SEQ ID NO: 28238 - RNA, 21 nt, Artificial Sequence
  Description of Artificial Sequence: Synthetic oligonucleotide
gagcuugggucaggucuucag

SEQ ID NO: 28239 - RNA, 21 nt, Artificial Sequence
  Description of Artificial Sequence: Synthetic oligonucleotide
agagcuugggucaggucuuca

SEQ ID NO: 28240 - RNA, 21 nt, Artificial Sequence
  Description of Artificial Sequence: Synthetic oligonucleotide
aagagcuugggucaggucuuc

SEQ ID NO: 28241 - RNA, 21 nt, Artificial Sequence
  Description of Artificial Sequence: Synthetic oligonucleotide
uaagagcuugggucaggucuu

SEQ ID NO: 28242 - RNA, 21 nt, Artificial Sequence
  Description of Artificial Sequence: Synthetic oligonucleotide
uuaagagcuugggucaggucu

SEQ ID NO: 28243 - RNA, 21 nt, Artificial Sequence
  Description of Artificial Sequence: Synthetic oligonucleotide
uuuaagagcuugggucagguc

SEQ ID NO: 28244 - RNA, 21 nt, Artificial Sequence
  Description of Artificial Sequence: Synthetic oligonucleotide
auuuaagagcuugggucaggu

SEQ ID NO: 28245 - RNA, 21 nt, Artificial Sequence
  Description of Artificial Sequence: Synthetic oligonucleotide
cauuuaagagcuugggucagg

SEQ ID NO: 28246 - RNA, 21 nt, Artificial Sequence
  Description of Artificial Sequence: Synthetic oligonucleotide
gcauuuaagagcuugggucag

SEQ ID NO: 28247 - RNA, 21 nt, Artificial Sequence
  Description of Artificial Sequence: Synthetic oligonucleotide
agcauuuaagagcuuggguca

SEQ ID NO: 28248 - RNA, 21 nt, Artificial Sequence
  Description of Artificial Sequence: Synthetic oligonucleotide
uagcauuuaagagcuuggguc

SEQ ID NO: 28249 - RNA, 21 nt, Artificial Sequence
  Description of Artificial Sequence: Synthetic oligonucleotide
auagcauuuaagagcuugggu

SEQ ID NO: 28250 - RNA, 21 nt, Artificial Sequence
  Description of Artificial Sequence: Synthetic oligonucleotide
aauagcauuuaagagcuuggg

SEQ ID NO: 28251 - RNA, 21 nt, Artificial Sequence
  Description of Artificial Sequence: Synthetic oligonucleotide
caauagcauuuaagagcuugg

SEQ ID NO: 28252 - RNA, 21 nt, Artificial Sequence
  Description of Artificial Sequence: Synthetic oligonucleotide
acaauagcauuuaagagcuug

SEQ ID NO: 28253 - RNA, 21 nt, Artificial Sequence
  Description of Artificial Sequence: Synthetic oligonucleotide
uacaauagcauuuaagagcuu

SEQ ID NO: 28254 - RNA, 21 nt, Artificial Sequence
  Description of Artificial Sequence: Synthetic oligonucleotide
uuacaauagcauuuaagagcu

SEQ ID NO: 28255 - RNA, 21 nt, Artificial Sequence
  Description of Artificial Sequence: Synthetic oligonucleotide
cuuacaauagcauuuaagagc

SEQ ID NO: 28256 - RNA, 21 nt, Artificial Sequence
  Description of Artificial Sequence: Synthetic oligonucleotide
ucuuacaauagcauuuaagag

SEQ ID NO: 28257 - RNA, 21 nt, Artificial Sequence
  Description of Artificial Sequence: Synthetic oligonucleotide
cucuuacaauagcauuuaaga

SEQ ID NO: 28258 - RNA, 21 nt, Artificial Sequence
  Description of Artificial Sequence: Synthetic oligonucleotide
ucucuuacaauagcauuuaag

SEQ ID NO: 28259 - RNA, 21 nt, Artificial Sequence
  Description of Artificial Sequence: Synthetic oligonucleotide
uucucuuacaauagcauuuaa

SEQ ID NO: 28260 - RNA, 21 nt, Artificial Sequence
  Description of Artificial Sequence: Synthetic oligonucleotide
uuucucuuacaauagcauuua

SEQ ID NO: 28261 - RNA, 21 nt, Artificial Sequence
  Description of Artificial Sequence: Synthetic oligonucleotide
auuucucuuacaauagcauuu

SEQ ID NO: 28262 - RNA, 21 nt, Artificial Sequence
  Description of Artificial Sequence: Synthetic oligonucleotide
aauuucucuuacaauagcauu

SEQ ID NO: 28263 - RNA, 21 nt, Artificial Sequence
  Description of Artificial Sequence: Synthetic oligonucleotide
aaauuucucuuacaauagcau

SEQ ID NO: 28264 - RNA, 21 nt, Artificial Sequence
  Description of Artificial Sequence: Synthetic oligonucleotide
gaaauuucucuuacaauagca

SEQ ID NO: 28265 - RNA, 21 nt, Artificial Sequence
  Description of Artificial Sequence: Synthetic oligonucleotide
agaaauuucucuuacaauagc

SEQ ID NO: 28266 - RNA, 21 nt, Artificial Sequence
  Description of Artificial Sequence: Synthetic oligonucleotide
aagaaauuucucuuacaauag

SEQ ID NO: 28267 - RNA, 21 nt, Artificial Sequence
  Description of Artificial Sequence: Synthetic oligonucleotide
aaagaaauuucucuuacaaua

SEQ ID NO: 28268 - RNA, 21 nt, Artificial Sequence
  Description of Artificial Sequence: Synthetic oligonucleotide
caaagaaauuucucuuacaau

SEQ ID NO: 28269 - RNA, 21 nt, Artificial Sequence
  Description of Artificial Sequence: Synthetic oligonucleotide
acaaagaaauuucucuuacaa

SEQ ID NO: 28270 - RNA, 21 nt, Artificial Sequence
  Description of Artificial Sequence: Synthetic oligonucleotide
gacaaagaaauuucucuuaca

SEQ ID NO: 28271 - RNA, 21 nt, Artificial Sequence
  Description of Artificial Sequence: Synthetic oligonucleotide
agacaaagaaauuucucuuac

SEQ ID NO: 28272 - RNA, 21 nt, Artificial Sequence
  Description of Artificial Sequence: Synthetic oligonucleotide
uagacaaagaaauuucucuua

SEQ ID NO: 28273 - RNA, 21 nt, Artificial Sequence
  Description of Artificial Sequence: Synthetic oligonucleotide
auagacaaagaaauuucucuu

SEQ ID NO: 28274 - RNA, 21 nt, Artificial Sequence
  Description of Artificial Sequence: Synthetic oligonucleotide
aauagacaaagaaauuucucu

SEQ ID NO: 28275 - RNA, 21 nt, Artificial Sequence
  Description of Artificial Sequence: Synthetic oligonucleotide
uaauagacaaagaaauuucuc

SEQ ID NO: 28276 - RNA, 21 nt, Artificial Sequence
  Description of Artificial Sequence: Synthetic oligonucleotide
uuaauagacaaagaaauuucu

SEQ ID NO: 28277 - RNA, 21 nt, Artificial Sequence
  Description of Artificial Sequence: Synthetic oligonucleotide
guuaauagacaaagaaauuuc

SEQ ID NO: 28278 - RNA, 21 nt, Artificial Sequence
  Description of Artificial Sequence: Synthetic oligonucleotide
aguuaauagacaaagaaauuu

SEQ ID NO: 28279 - RNA, 21 nt, Artificial Sequence
  Description of Artificial Sequence: Synthetic oligonucleotide
gaguuaauagacaaagaaauu

SEQ ID NO: 28280 - RNA, 21 nt, Artificial Sequence
  Description of Artificial Sequence: Synthetic oligonucleotide
ggaguuaauagacaaagaaau

SEQ ID NO: 28281 - RNA, 21 nt, Artificial Sequence
  Description of Artificial Sequence: Synthetic oligonucleotide
uggaguuaauagacaaagaaa

SEQ ID NO: 28282 - RNA, 21 nt, Artificial Sequence
  Description of Artificial Sequence: Synthetic oligonucleotide
auggaguuaauagacaaagaa

SEQ ID NO: 28283 - RNA, 21 nt, Artificial Sequence
  Description of Artificial Sequence: Synthetic oligonucleotide
aauggaguuaauagacaaaga

SEQ ID NO: 28284 - RNA, 21 nt, Artificial Sequence
  Description of Artificial Sequence: Synthetic oligonucleotide
aaauggaguuaauagacaaag

SEQ ID NO: 28285 - RNA, 21 nt, Artificial Sequence
  Description of Artificial Sequence: Synthetic oligonucleotide
aaaauggaguuaauagacaaa

SEQ ID NO: 28286 - RNA, 21 nt, Artificial Sequence
  Description of Artificial Sequence: Synthetic oligonucleotide
uaaaauggaguuaauagacaa

SEQ ID NO: 28287 - RNA, 21 nt, Artificial Sequence
  Description of Artificial Sequence: Synthetic oligonucleotide
cuaaaauggaguuaauagaca

SEQ ID NO: 28288 - RNA, 21 nt, Artificial Sequence
  Description of Artificial Sequence: Synthetic oligonucleotide
acuaaaauggaguuaauagac

SEQ ID NO: 28289 - RNA, 21 nt, Artificial Sequence
  Description of Artificial Sequence: Synthetic oligonucleotide
uacuaaaauggaguuaauaga

SEQ ID NO: 28290 - RNA, 21 nt, Artificial Sequence
  Description of Artificial Sequence: Synthetic oligonucleotide
cuacuaaaauggaguuaauag

SEQ ID NO: 28291 - RNA, 21 nt, Artificial Sequence
  Description of Artificial Sequence: Synthetic oligonucleotide
ccuacuaaaauggaguuaaua

SEQ ID NO: 28292 - RNA, 21 nt, Artificial Sequence
  Description of Artificial Sequence: Synthetic oligonucleotide
cccuacuaaaauggaguuaau

SEQ ID NO: 28293 - RNA, 21 nt, Artificial Sequence
  Description of Artificial Sequence: Synthetic oligonucleotide
ucccuacuaaaauggaguuaa

SEQ ID NO: 28294 - RNA, 21 nt, Artificial Sequence
  Description of Artificial Sequence: Synthetic oligonucleotide
aucccuacuaaaauggaguua

SEQ ID NO: 28295 - RNA, 21 nt, Artificial Sequence
  Description of Artificial Sequence: Synthetic oligonucleotide
aaucccuacuaaaauggaguu

SEQ ID NO: 28296 - RNA, 21 nt, Artificial Sequence
  Description of Artificial Sequence: Synthetic oligonucleotide
gaaucccuacuaaaauggagu

SEQ ID NO: 28297 - RNA, 21 nt, Artificial Sequence
  Description of Artificial Sequence: Synthetic oligonucleotide
ugaaucccuacuaaaauggag

SEQ ID NO: 28298 - RNA, 21 nt, Artificial Sequence
  Description of Artificial Sequence: Synthetic oligonucleotide
gugaaucccuacuaaaaugga

SEQ ID NO: 28299 - RNA, 21 nt, Artificial Sequence
  Description of Artificial Sequence: Synthetic oligonucleotide
agugaaucccuacuaaaaugg

SEQ ID NO: 28300 - RNA, 21 nt, Artificial Sequence
  Description of Artificial Sequence: Synthetic oligonucleotide
cagugaaucccuacuaaaaug

SEQ ID NO: 28301 - RNA, 21 nt, Artificial Sequence
  Description of Artificial Sequence: Synthetic oligonucleotide
ucagugaaucccuacuaaaau

SEQ ID NO: 28302 - RNA, 21 nt, Artificial Sequence
  Description of Artificial Sequence: Synthetic oligonucleotide
gucagugaaucccuacuaaaa

SEQ ID NO: 28303 - RNA, 21 nt, Artificial Sequence
  Description of Artificial Sequence: Synthetic oligonucleotide
agucagugaaucccuacuaaa

SEQ ID NO: 28304 - RNA, 21 nt, Artificial Sequence
  Description of Artificial Sequence: Synthetic oligonucleotide
uagucagugaaucccuacuaa

SEQ ID NO: 28305 - RNA, 21 nt, Artificial Sequence
  Description of Artificial Sequence: Synthetic oligonucleotide
cuagucagugaaucccuacua

SEQ ID NO: 28306 - RNA, 21 nt, Artificial Sequence
  Description of Artificial Sequence: Synthetic oligonucleotide
ucuagucagugaaucccuacu

SEQ ID NO: 28307 - RNA, 21 nt, Artificial Sequence
  Description of Artificial Sequence: Synthetic oligonucleotide
aucuagucagugaaucccuac

SEQ ID NO: 28308 - RNA, 21 nt, Artificial Sequence
  Description of Artificial Sequence: Synthetic oligonucleotide
aaucuagucagugaaucccua

SEQ ID NO: 28309 - RNA, 21 nt, Artificial Sequence
  Description of Artificial Sequence: Synthetic oligonucleotide
aaaucuagucagugaaucccu

SEQ ID NO: 28310 - RNA, 21 nt, Artificial Sequence
  Description of Artificial Sequence: Synthetic oligonucleotide
aaaaucuagucagugaauccc

SEQ ID NO: 28311 - RNA, 21 nt, Artificial Sequence
  Description of Artificial Sequence: Synthetic oligonucleotide
uaaaaucuagucagugaaucc

SEQ ID NO: 28312 - RNA, 21 nt, Artificial Sequence
  Description of Artificial Sequence: Synthetic oligonucleotide
guaaaaucuagucagugaauc

SEQ ID NO: 28313 - RNA, 21 nt, Artificial Sequence
  Description of Artificial Sequence: Synthetic oligonucleotide
aguaaaaucuagucagugaau

SEQ ID NO: 28314 - RNA, 21 nt, Artificial Sequence
  Description of Artificial Sequence: Synthetic oligonucleotide
caguaaaaucuagucagugaa

SEQ ID NO: 28315 - RNA, 21 nt, Artificial Sequence
  Description of Artificial Sequence: Synthetic oligonucleotide
ucaguaaaaucuagucaguga

SEQ ID NO: 28316 - RNA, 21 nt, Artificial Sequence
  Description of Artificial Sequence: Synthetic oligonucleotide
uucaguaaaaucuagucagug

SEQ ID NO: 28317 - RNA, 21 nt, Artificial Sequence
  Description of Artificial Sequence: Synthetic oligonucleotide
guucaguaaaaucuagucagu

SEQ ID NO: 28318 - RNA, 21 nt, Artificial Sequence
  Description of Artificial Sequence: Synthetic oligonucleotide
aguucaguaaaaucuagucag

SEQ ID NO: 28319 - RNA, 21 nt, Artificial Sequence
  Description of Artificial Sequence: Synthetic oligonucleotide
uaguucaguaaaaucuaguca

SEQ ID NO: 28320 - RNA, 21 nt, Artificial Sequence
  Description of Artificial Sequence: Synthetic oligonucleotide
auaguucaguaaaaucuaguc

SEQ ID NO: 28321 - RNA, 21 nt, Artificial Sequence
  Description of Artificial Sequence: Synthetic oligonucleotide
cauaguucaguaaaaucuagu

SEQ ID NO: 28322 - RNA, 21 nt, Artificial Sequence
  Description of Artificial Sequence: Synthetic oligonucleotide
ucauaguucaguaaaaucuag

SEQ ID NO: 28323 - RNA, 21 nt, Artificial Sequence
  Description of Artificial Sequence: Synthetic oligonucleotide
uucauaguucaguaaaaucua

SEQ ID NO: 28324 - RNA, 21 nt, Artificial Sequence
  Description of Artificial Sequence: Synthetic oligonucleotide
uuucauaguucaguaaaaucu

SEQ ID NO: 28325 - RNA, 21 nt, Artificial Sequence
  Description of Artificial Sequence: Synthetic oligonucleotide
uuuucauaguucaguaaaauc

SEQ ID NO: 28326 - RNA, 21 nt, Artificial Sequence
  Description of Artificial Sequence: Synthetic oligonucleotide
auuuucauaguucaguaaaau

SEQ ID NO: 28327 - RNA, 21 nt, Artificial Sequence
  Description of Artificial Sequence: Synthetic oligonucleotide
uauuuucauaguucaguaaaa

SEQ ID NO: 28328 - RNA, 21 nt, Artificial Sequence
  Description of Artificial Sequence: Synthetic oligonucleotide
uuauuuucauaguucaguaaa

SEQ ID NO: 28329 - RNA, 21 nt, Artificial Sequence
  Description of Artificial Sequence: Synthetic oligonucleotide
uuuauuuucauaguucaguaa

SEQ ID NO: 28330 - RNA, 21 nt, Artificial Sequence
  Description of Artificial Sequence: Synthetic oligonucleotide
auuuauuuucauaguucagua

SEQ ID NO: 28331 - RNA, 21 nt, Artificial Sequence
  Description of Artificial Sequence: Synthetic oligonucleotide
uauuuauuuucauaguucagu

SEQ ID NO: 28332 - RNA, 21 nt, Artificial Sequence
  Description of Artificial Sequence: Synthetic oligonucleotide
guauuuauuuucauaguucag

SEQ ID NO: 28333 - RNA, 21 nt, Artificial Sequence
  Description of Artificial Sequence: Synthetic oligonucleotide
uguauuuauuuucauaguuca

SEQ ID NO: 28334 - RNA, 21 nt, Artificial Sequence
  Description of Artificial Sequence: Synthetic oligonucleotide
guguauuuauuuucauaguuc

SEQ ID NO: 28335 - RNA, 21 nt, Artificial Sequence
  Description of Artificial Sequence: Synthetic oligonucleotide
uguguauuuauuuucauaguu

SEQ ID NO: 28336 - RNA, 21 nt, Artificial Sequence
  Description of Artificial Sequence: Synthetic oligonucleotide
auguguauuuauuuucauagu

SEQ ID NO: 28337 - RNA, 21 nt, Artificial Sequence
  Description of Artificial Sequence: Synthetic oligonucleotide
uauguguauuuauuuucauag

SEQ ID NO: 28338 - RNA, 21 nt, Artificial Sequence
  Description of Artificial Sequence: Synthetic oligonucleotide
uuauguguauuuauuuucaua

SEQ ID NO: 28339 - RNA, 21 nt, Artificial Sequence
  Description of Artificial Sequence: Synthetic oligonucleotide
auuauguguauuuauuuucau

SEQ ID NO: 28340 - RNA, 21 nt, Artificial Sequence
  Description of Artificial Sequence: Synthetic oligonucleotide
aauuauguguauuuauuuuca

SEQ ID NO: 28341 - RNA, 21 nt, Artificial Sequence
  Description of Artificial Sequence: Synthetic oligonucleotide
aaauuauguguauuuauuuuc

SEQ ID NO: 28342 - RNA, 21 nt, Artificial Sequence
  Description of Artificial Sequence: Synthetic oligonucleotide
aaaauuauguguauuuauuuu

SEQ ID NO: 28343 - RNA, 21 nt, Artificial Sequence
  Description of Artificial Sequence: Synthetic oligonucleotide
aaaaauuauguguauuuauuu

SEQ ID NO: 28344 - RNA, 21 nt, Artificial Sequence
  Description of Artificial Sequence: Synthetic oligonucleotide
gaaaaauuauguguauuuauu

SEQ ID NO: 28345 - RNA, 21 nt, Artificial Sequence
  Description of Artificial Sequence: Synthetic oligonucleotide
ugaaaaauuauguguauuuau

SEQ ID NO: 28346 - RNA, 21 nt, Artificial Sequence
  Description of Artificial Sequence: Synthetic oligonucleotide
gugaaaaauuauguguauuua

SEQ ID NO: 28347 - RNA, 21 nt, Artificial Sequence
  Description of Artificial Sequence: Synthetic oligonucleotide
ugugaaaaauuauguguauuu

SEQ ID NO: 28348 - RNA, 21 nt, Artificial Sequence
  Description of Artificial Sequence: Synthetic oligonucleotide
uugugaaaaauuauguguauu

SEQ ID NO: 28349 - RNA, 21 nt, Artificial Sequence
  Description of Artificial Sequence: Synthetic oligonucleotide
uuugugaaaaauuauguguau

SEQ ID NO: 28350 - RNA, 21 nt, Artificial Sequence
  Description of Artificial Sequence: Synthetic oligonucleotide
uuuugugaaaaauuaugugua

SEQ ID NO: 28351 - RNA, 21 nt, Artificial Sequence
  Description of Artificial Sequence: Synthetic oligonucleotide
auuuugugaaaaauuaugugu

SEQ ID NO: 28352 - RNA, 21 nt, Artificial Sequence
  Description of Artificial Sequence: Synthetic oligonucleotide
aauuuugugaaaaauuaugug

SEQ ID NO: 28353 - RNA, 21 nt, Artificial Sequence
  Description of Artificial Sequence: Synthetic oligonucleotide
aaauuuugugaaaaauuaugu

SEQ ID NO: 28354 - RNA, 21 nt, Artificial Sequence
  Description of Artificial Sequence: Synthetic oligonucleotide
aaaauuuugugaaaaauuaug

SEQ ID NO: 28355 - RNA, 21 nt, Artificial Sequence
  Description of Artificial Sequence: Synthetic oligonucleotide
caaaauuuugugaaaaauuau

SEQ ID NO: 28356 - RNA, 21 nt, Artificial Sequence
  Description of Artificial Sequence: Synthetic oligonucleotide
ccaaaauuuugugaaaaauua

SEQ ID NO: 28357 - RNA, 21 nt, Artificial Sequence
  Description of Artificial Sequence: Synthetic oligonucleotide
cccaaaauuuugugaaaaauu

SEQ ID NO: 28358 - RNA, 21 nt, Artificial Sequence
  Description of Artificial Sequence: Synthetic oligonucleotide
gcccaaaauuuugugaaaaau

SEQ ID NO: 28359 - RNA, 21 nt, Artificial Sequence
  Description of Artificial Sequence: Synthetic oligonucleotide
ggcccaaaauuuugugaaaaa

SEQ ID NO: 28360 - RNA, 21 nt, Artificial Sequence
  Description of Artificial Sequence: Synthetic oligonucleotide
gggcccaaaauuuugugaaaa

SEQ ID NO: 28361 - RNA, 21 nt, Artificial Sequence
  Description of Artificial Sequence: Synthetic oligonucleotide
ugggcccaaaauuuugugaaa

SEQ ID NO: 28362 - RNA, 21 nt, Artificial Sequence
  Description of Artificial Sequence: Synthetic oligonucleotide
uugggcccaaaauuuugugaa

SEQ ID NO: 28363 - RNA, 21 nt, Artificial Sequence
  Description of Artificial Sequence: Synthetic oligonucleotide
auugggcccaaaauuuuguga

SEQ ID NO: 28364 - RNA, 21 nt, Artificial Sequence
  Description of Artificial Sequence: Synthetic oligonucleotide
aauugggcccaaaauuuugug

SEQ ID NO: 28365 - RNA, 21 nt, Artificial Sequence
  Description of Artificial Sequence: Synthetic oligonucleotide
gaauugggcccaaaauuuugu

SEQ ID NO: 28366 - RNA, 21 nt, Artificial Sequence
  Description of Artificial Sequence: Synthetic oligonucleotide
ggaauugggcccaaaauuuug

SEQ ID NO: 28367 - RNA, 21 nt, Artificial Sequence
  Description of Artificial Sequence: Synthetic oligonucleotide
gggaauugggcccaaaauuuu

SEQ ID NO: 28368 - RNA, 21 nt, Artificial Sequence
  Description of Artificial Sequence: Synthetic oligonucleotide
ggggaauugggcccaaaauuu

SEQ ID NO: 28369 - RNA, 21 nt, Artificial Sequence
  Description of Artificial Sequence: Synthetic oligonucleotide
aggggaauugggcccaaaauu

SEQ ID NO: 28370 - RNA, 21 nt, Artificial Sequence
  Description of Artificial Sequence: Synthetic oligonucleotide
uaggggaauugggcccaaaau

SEQ ID NO: 28371 - RNA, 21 nt, Artificial Sequence
  Description of Artificial Sequence: Synthetic oligonucleotide
uuaggggaauugggcccaaaa

SEQ ID NO: 28372 - RNA, 21 nt, Artificial Sequence
  Description of Artificial Sequence: Synthetic oligonucleotide
uuuaggggaauugggcccaaa

SEQ ID NO: 28373 - RNA, 21 nt, Artificial Sequence
  Description of Artificial Sequence: Synthetic oligonucleotide
uuuuaggggaauugggcccaa

SEQ ID NO: 28374 - RNA, 21 nt, Artificial Sequence
  Description of Artificial Sequence: Synthetic oligonucleotide
cuuuuaggggaauugggccca

SEQ ID NO: 28375 - RNA, 21 nt, Artificial Sequence
  Description of Artificial Sequence: Synthetic oligonucleotide
ucuuuuaggggaauugggccc

SEQ ID NO: 28376 - RNA, 21 nt, Artificial Sequence
  Description of Artificial Sequence: Synthetic oligonucleotide
uucuuuuaggggaauugggcc

SEQ ID NO: 28377 - RNA, 21 nt, Artificial Sequence
  Description of Artificial Sequence: Synthetic oligonucleotide
auucuuuuaggggaauugggc

SEQ ID NO: 28378 - RNA, 21 nt, Artificial Sequence
  Description of Artificial Sequence: Synthetic oligonucleotide
aauucuuuuaggggaauuggg

SEQ ID NO: 28379 - RNA, 21 nt, Artificial Sequence
  Description of Artificial Sequence: Synthetic oligonucleotide
caauucuuuuaggggaauugg

SEQ ID NO: 28380 - RNA, 21 nt, Artificial Sequence
  Description of Artificial Sequence: Synthetic oligonucleotide
ucaauucuuuuaggggaauug

SEQ ID NO: 28381 - RNA, 21 nt, Artificial Sequence
  Description of Artificial Sequence: Synthetic oligonucleotide
cucaauucuuuuaggggaauu

SEQ ID NO: 28382 - RNA, 21 nt, Artificial Sequence
  Description of Artificial Sequence: Synthetic oligonucleotide
ccucaauucuuuuaggggaau

SEQ ID NO: 28383 - RNA, 21 nt, Artificial Sequence
  Description of Artificial Sequence: Synthetic oligonucleotide
uccucaauucuuuuaggggaa

SEQ ID NO: 28384 - RNA, 21 nt, Artificial Sequence
  Description of Artificial Sequence: Synthetic oligonucleotide
auccucaauucuuuuagggga

SEQ ID NO: 28385 - RNA, 21 nt, Artificial Sequence
  Description of Artificial Sequence: Synthetic oligonucleotide
aauccucaauucuuuuagggg

SEQ ID NO: 28386 - RNA, 21 nt, Artificial Sequence
  Description of Artificial Sequence: Synthetic oligonucleotide
uaauccucaauucuuuuaggg

SEQ ID NO: 28387 - RNA, 21 nt, Artificial Sequence
  Description of Artificial Sequence: Synthetic oligonucleotide
cuaauccucaauucuuuuagg

SEQ ID NO: 28388 - RNA, 21 nt, Artificial Sequence
  Description of Artificial Sequence: Synthetic oligonucleotide
ccuaauccucaauucuuuuag

SEQ ID NO: 28389 - RNA, 21 nt, Artificial Sequence
  Description of Artificial Sequence: Synthetic oligonucleotide
cccuaauccucaauucuuuua

SEQ ID NO: 28390 - RNA, 21 nt, Artificial Sequence
  Description of Artificial Sequence: Synthetic oligonucleotide
ucccuaauccucaauucuuuu

SEQ ID NO: 28391 - RNA, 21 nt, Artificial Sequence
  Description of Artificial Sequence: Synthetic oligonucleotide
cucccuaauccucaauucuuu

SEQ ID NO: 28392 - RNA, 21 nt, Artificial Sequence
  Description of Artificial Sequence: Synthetic oligonucleotide
ucucccuaauccucaauucuu

SEQ ID NO: 28393 - RNA, 21 nt, Artificial Sequence
  Description of Artificial Sequence: Synthetic oligonucleotide
uucucccuaauccucaauucu

SEQ ID NO: 28394 - RNA, 21 nt, Artificial Sequence
  Description of Artificial Sequence: Synthetic oligonucleotide
uuucucccuaauccucaauuc

SEQ ID NO: 28395 - RNA, 21 nt, Artificial Sequence
  Description of Artificial Sequence: Synthetic oligonucleotide
cuuucucccuaauccucaauu

SEQ ID NO: 28396 - RNA, 21 nt, Artificial Sequence
  Description of Artificial Sequence: Synthetic oligonucleotide
ccuuucucccuaauccucaau

SEQ ID NO: 28397 - RNA, 21 nt, Artificial Sequence
  Description of Artificial Sequence: Synthetic oligonucleotide
uccuuucucccuaauccucaa

SEQ ID NO: 28398 - RNA, 21 nt, Artificial Sequence
  Description of Artificial Sequence: Synthetic oligonucleotide
cuccuuucucccuaauccuca

SEQ ID NO: 28399 - RNA, 21 nt, Artificial Sequence
  Description of Artificial Sequence: Synthetic oligonucleotide
ucuccuuucucccuaauccuc

SEQ ID NO: 28400 - RNA, 21 nt, Artificial Sequence
  Description of Artificial Sequence: Synthetic oligonucleotide
gucuccuuucucccuaauccu

SEQ ID NO: 28401 - RNA, 21 nt, Artificial Sequence
  Description of Artificial Sequence: Synthetic oligonucleotide
ugucuccuuucucccuaaucc

SEQ ID NO: 28402 - RNA, 21 nt, Artificial Sequence
  Description of Artificial Sequence: Synthetic oligonucleotide
uugucuccuuucucccuaauc

SEQ ID NO: 28403 - RNA, 21 nt, Artificial Sequence
  Description of Artificial Sequence: Synthetic oligonucleotide
guugucuccuuucucccuaau

SEQ ID NO: 28404 - RNA, 21 nt, Artificial Sequence
  Description of Artificial Sequence: Synthetic oligonucleotide
aguugucuccuuucucccuaa

SEQ ID NO: 28405 - RNA, 21 nt, Artificial Sequence
  Description of Artificial Sequence: Synthetic oligonucleotide
gaguugucuccuuucucccua

SEQ ID NO: 28406 - RNA, 21 nt, Artificial Sequence
  Description of Artificial Sequence: Synthetic oligonucleotide
ugaguugucuccuuucucccu

SEQ ID NO: 28407 - RNA, 21 nt, Artificial Sequence
  Description of Artificial Sequence: Synthetic oligonucleotide
uugaguugucuccuuucuccc

SEQ ID NO: 28408 - RNA, 21 nt, Artificial Sequence
  Description of Artificial Sequence: Synthetic oligonucleotide
uuugaguugucuccuuucucc

SEQ ID NO: 28409 - RNA, 21 nt, Artificial Sequence
  Description of Artificial Sequence: Synthetic oligonucleotide
cuuugaguugucuccuuucuc

SEQ ID NO: 28410 - RNA, 21 nt, Artificial Sequence
  Description of Artificial Sequence: Synthetic oligonucleotide
acuuugaguugucuccuuucu

SEQ ID NO: 28411 - RNA, 21 nt, Artificial Sequence
  Description of Artificial Sequence: Synthetic oligonucleotide
gacuuugaguugucuccuuuc

SEQ ID NO: 28412 - RNA, 21 nt, Artificial Sequence
  Description of Artificial Sequence: Synthetic oligonucleotide
ugacuuugaguugucuccuuu

SEQ ID NO: 28413 - RNA, 21 nt, Artificial Sequence
  Description of Artificial Sequence: Synthetic oligonucleotide
augacuuugaguugucuccuu

SEQ ID NO: 28414 - RNA, 21 nt, Artificial Sequence
  Description of Artificial Sequence: Synthetic oligonucleotide
gaugacuuugaguugucuccu

SEQ ID NO: 28415 - RNA, 21 nt, Artificial Sequence
  Description of Artificial Sequence: Synthetic oligonucleotide
ggaugacuuugaguugucucc

SEQ ID NO: 28416 - RNA, 21 nt, Artificial Sequence
  Description of Artificial Sequence: Synthetic oligonucleotide
gggaugacuuugaguugucuc

SEQ ID NO: 28417 - RNA, 21 nt, Artificial Sequence
  Description of Artificial Sequence: Synthetic oligonucleotide
ugggaugacuuugaguugucu

SEQ ID NO: 28418 - RNA, 21 nt, Artificial Sequence
  Description of Artificial Sequence: Synthetic oligonucleotide
augggaugacuuugaguuguc

SEQ ID NO: 28419 - RNA, 21 nt, Artificial Sequence
  Description of Artificial Sequence: Synthetic oligonucleotide
aaugggaugacuuugaguugu

SEQ ID NO: 28420 - RNA, 21 nt, Artificial Sequence
  Description of Artificial Sequence: Synthetic oligonucleotide
uaaugggaugacuuugaguug

SEQ ID NO: 28421 - RNA, 21 nt, Artificial Sequence
  Description of Artificial Sequence: Synthetic oligonucleotide
uuaaugggaugacuuugaguu

SEQ ID NO: 28422 - RNA, 21 nt, Artificial Sequence
  Description of Artificial Sequence: Synthetic oligonucleotide
cuuaaugggaugacuuugagu

SEQ ID NO: 28423 - RNA, 21 nt, Artificial Sequence
  Description of Artificial Sequence: Synthetic oligonucleotide
acuuaaugggaugacuuugag

SEQ ID NO: 28424 - RNA, 21 nt, Artificial Sequence
  Description of Artificial Sequence: Synthetic oligonucleotide
cacuuaaugggaugacuuuga

SEQ ID NO: 28425 - RNA, 21 nt, Artificial Sequence
  Description of Artificial Sequence: Synthetic oligonucleotide
gcacuuaaugggaugacuuug

SEQ ID NO: 28426 - RNA, 21 nt, Artificial Sequence
  Description of Artificial Sequence: Synthetic oligonucleotide
ugcacuuaaugggaugacuuu

SEQ ID NO: 28427 - RNA, 21 nt, Artificial Sequence
  Description of Artificial Sequence: Synthetic oligonucleotide
cugcacuuaaugggaugacuu

SEQ ID NO: 28428 - RNA, 21 nt, Artificial Sequence
  Description of Artificial Sequence: Synthetic oligonucleotide
acugcacuuaaugggaugacu

SEQ ID NO: 28429 - RNA, 21 nt, Artificial Sequence
  Description of Artificial Sequence: Synthetic oligonucleotide
aacugcacuuaaugggaugac

SEQ ID NO: 28430 - RNA, 21 nt, Artificial Sequence
  Description of Artificial Sequence: Synthetic oligonucleotide
aaacugcacuuaaugggauga

SEQ ID NO: 28431 - RNA, 21 nt, Artificial Sequence
  Description of Artificial Sequence: Synthetic oligonucleotide
gaaacugcacuuaaugggaug

SEQ ID NO: 28432 - RNA, 21 nt, Artificial Sequence
  Description of Artificial Sequence: Synthetic oligonucleotide
agaaacugcacuuaaugggau

SEQ ID NO: 28433 - RNA, 21 nt, Artificial Sequence
  Description of Artificial Sequence: Synthetic oligonucleotide
aagaaacugcacuuaauggga

SEQ ID NO: 28434 - RNA, 21 nt, Artificial Sequence
  Description of Artificial Sequence: Synthetic oligonucleotide
aaagaaacugcacuuaauggg

SEQ ID NO: 28435 - RNA, 21 nt, Artificial Sequence
  Description of Artificial Sequence: Synthetic oligonucleotide
caaagaaacugcacuuaaugg

SEQ ID NO: 28436 - RNA, 21 nt, Artificial Sequence
  Description of Artificial Sequence: Synthetic oligonucleotide
ucaaagaaacugcacuuaaug

SEQ ID NO: 28437 - RNA, 21 nt, Artificial Sequence
  Description of Artificial Sequence: Synthetic oligonucleotide
uucaaagaaacugcacuuaau

SEQ ID NO: 28438 - RNA, 21 nt, Artificial Sequence
  Description of Artificial Sequence: Synthetic oligonucleotide
auucaaagaaacugcacuuaa

SEQ ID NO: 28439 - RNA, 21 nt, Artificial Sequence
  Description of Artificial Sequence: Synthetic oligonucleotide
gauucaaagaaacugcacuua

SEQ ID NO: 28440 - RNA, 21 nt, Artificial Sequence
  Description of Artificial Sequence: Synthetic oligonucleotide
agauucaaagaaacugcacuu

SEQ ID NO: 28441 - RNA, 21 nt, Artificial Sequence
  Description of Artificial Sequence: Synthetic oligonucleotide
aagauucaaagaaacugcacu

SEQ ID NO: 28442 - RNA, 21 nt, Artificial Sequence
  Description of Artificial Sequence: Synthetic oligonucleotide
gaagauucaaagaaacugcac

SEQ ID NO: 28443 - RNA, 21 nt, Artificial Sequence
  Description of Artificial Sequence: Synthetic oligonucleotide
agaagauucaaagaaacugca

SEQ ID NO: 28444 - RNA, 21 nt, Artificial Sequence
  Description of Artificial Sequence: Synthetic oligonucleotide
cagaagauucaaagaaacugc

SEQ ID NO: 28445 - RNA, 21 nt, Artificial Sequence
  Description of Artificial Sequence: Synthetic oligonucleotide
gcagaagauucaaagaaacug

SEQ ID NO: 28446 - RNA, 21 nt, Artificial Sequence
  Description of Artificial Sequence: Synthetic oligonucleotide
agcagaagauucaaagaaacu

SEQ ID NO: 28447 - RNA, 21 nt, Artificial Sequence
  Description of Artificial Sequence: Synthetic oligonucleotide
aagcagaagauucaaagaaac

SEQ ID NO: 28448 - RNA, 21 nt, Artificial Sequence
  Description of Artificial Sequence: Synthetic oligonucleotide
aaagcagaagauucaaagaaa

SEQ ID NO: 28449 - RNA, 21 nt, Artificial Sequence
  Description of Artificial Sequence: Synthetic oligonucleotide
uaaagcagaagauucaaagaa

SEQ ID NO: 28450 - RNA, 21 nt, Artificial Sequence
  Description of Artificial Sequence: Synthetic oligonucleotide
auaaagcagaagauucaaaga

SEQ ID NO: 28451 - RNA, 21 nt, Artificial Sequence
  Description of Artificial Sequence: Synthetic oligonucleotide
gauaaagcagaagauucaaag

SEQ ID NO: 28452 - RNA, 21 nt, Artificial Sequence
  Description of Artificial Sequence: Synthetic oligonucleotide
agauaaagcagaagauucaaa

SEQ ID NO: 28453 - RNA, 21 nt, Artificial Sequence
  Description of Artificial Sequence: Synthetic oligonucleotide
aagauaaagcagaagauucaa

SEQ ID NO: 28454 - RNA, 21 nt, Artificial Sequence
  Description of Artificial Sequence: Synthetic oligonucleotide
aaagauaaagcagaagauuca

SEQ ID NO: 28455 - RNA, 21 nt, Artificial Sequence
  Description of Artificial Sequence: Synthetic oligonucleotide
uaaagauaaagcagaagauuc

SEQ ID NO: 28456 - RNA, 21 nt, Artificial Sequence
  Description of Artificial Sequence: Synthetic oligonucleotide
uuaaagauaaagcagaagauu

SEQ ID NO: 28457 - RNA, 21 nt, Artificial Sequence
  Description of Artificial Sequence: Synthetic oligonucleotide
uuuaaagauaaagcagaagau

SEQ ID NO: 28458 - RNA, 21 nt, Artificial Sequence
  Description of Artificial Sequence: Synthetic oligonucleotide
uuuuaaagauaaagcagaaga

SEQ ID NO: 28459 - RNA, 21 nt, Artificial Sequence
  Description of Artificial Sequence: Synthetic oligonucleotide
uuuuuaaagauaaagcagaag

SEQ ID NO: 28460 - RNA, 21 nt, Artificial Sequence
  Description of Artificial Sequence: Synthetic oligonucleotide
auuuuuaaagauaaagcagaa

SEQ ID NO: 28461 - RNA, 21 nt, Artificial Sequence
  Description of Artificial Sequence: Synthetic oligonucleotide
aauuuuuaaagauaaagcaga

SEQ ID NO: 28462 - RNA, 21 nt, Artificial Sequence
  Description of Artificial Sequence: Synthetic oligonucleotide
aaauuuuuaaagauaaagcag

SEQ ID NO: 28463 - RNA, 21 nt, Artificial Sequence
  Description of Artificial Sequence: Synthetic oligonucleotide
caaauuuuuaaagauaaagca

SEQ ID NO: 28464 - RNA, 21 nt, Artificial Sequence
  Description of Artificial Sequence: Synthetic oligonucleotide
acaaauuuuuaaagauaaagc

SEQ ID NO: 28465 - RNA, 21 nt, Artificial Sequence
  Description of Artificial Sequence: Synthetic oligonucleotide
uacaaauuuuuaaagauaaag

SEQ ID NO: 28466 - RNA, 21 nt, Artificial Sequence
  Description of Artificial Sequence: Synthetic oligonucleotide
auacaaauuuuuaaagauaaa

SEQ ID NO: 28467 - RNA, 21 nt, Artificial Sequence
  Description of Artificial Sequence: Synthetic oligonucleotide
uauacaaauuuuuaaagauaa

SEQ ID NO: 28468 - RNA, 21 nt, Artificial Sequence
  Description of Artificial Sequence: Synthetic oligonucleotide
uuauacaaauuuuuaaagaua

SEQ ID NO: 28469 - RNA, 21 nt, Artificial Sequence
  Description of Artificial Sequence: Synthetic oligonucleotide
auuauacaaauuuuuaaagau

SEQ ID NO: 28470 - RNA, 21 nt, Artificial Sequence
  Description of Artificial Sequence: Synthetic oligonucleotide
aauuauacaaauuuuuaaaga

SEQ ID NO: 28471 - RNA, 21 nt, Artificial Sequence
  Description of Artificial Sequence: Synthetic oligonucleotide
aaauuauacaaauuuuuaaag

SEQ ID NO: 28472 - RNA, 21 nt, Artificial Sequence
  Description of Artificial Sequence: Synthetic oligonucleotide
uaaauuauacaaauuuuuaaa

SEQ ID NO: 28473 - RNA, 21 nt, Artificial Sequence
  Description of Artificial Sequence: Synthetic oligonucleotide
auaaauuauacaaauuuuuaa

SEQ ID NO: 28474 - RNA, 21 nt, Artificial Sequence
  Description of Artificial Sequence: Synthetic oligonucleotide
uauaaauuauacaaauuuuua

SEQ ID NO: 28475 - RNA, 21 nt, Artificial Sequence
  Description of Artificial Sequence: Synthetic oligonucleotide
auauaaauuauacaaauuuuu

SEQ ID NO: 28476 - RNA, 21 nt, Artificial Sequence
  Description of Artificial Sequence: Synthetic oligonucleotide
uauauaaauuauacaaauuuu

SEQ ID NO: 28477 - RNA, 21 nt, Artificial Sequence
  Description of Artificial Sequence: Synthetic oligonucleotide
auauauaaauuauacaaauuu

SEQ ID NO: 28478 - RNA, 21 nt, Artificial Sequence
  Description of Artificial Sequence: Synthetic oligonucleotide
aauauauaaauuauacaaauu

SEQ ID NO: 28479 - RNA, 21 nt, Artificial Sequence
  Description of Artificial Sequence: Synthetic oligonucleotide
aaauauauaaauuauacaaau

SEQ ID NO: 28480 - RNA, 21 nt, Artificial Sequence
  Description of Artificial Sequence: Synthetic oligonucleotide
aaaauauauaaauuauacaaa

SEQ ID NO: 28481 - RNA, 21 nt, Artificial Sequence
  Description of Artificial Sequence: Synthetic oligonucleotide
uaaaauauauaaauuauacaa

SEQ ID NO: 28482 - RNA, 21 nt, Artificial Sequence
  Description of Artificial Sequence: Synthetic oligonucleotide
auaaaauauauaaauuauaca

SEQ ID NO: 28483 - RNA, 21 nt, Artificial Sequence
  Description of Artificial Sequence: Synthetic oligonucleotide
aauaaaauauauaaauuauac

SEQ ID NO: 28484 - RNA, 21 nt, Artificial Sequence
  Description of Artificial Sequence: Synthetic oligonucleotide
gaauaaaauauauaaauuaua

SEQ ID NO: 28485 - RNA, 21 nt, Artificial Sequence
  Description of Artificial Sequence: Synthetic oligonucleotide
agaauaaaauauauaaauuau

SEQ ID NO: 28486 - RNA, 21 nt, Artificial Sequence
  Description of Artificial Sequence: Synthetic oligonucleotide
uagaauaaaauauauaaauua

SEQ ID NO: 28487 - RNA, 21 nt, Artificial Sequence
  Description of Artificial Sequence: Synthetic oligonucleotide
auagaauaaaauauauaaauu

SEQ ID NO: 28488 - RNA, 21 nt, Artificial Sequence
  Description of Artificial Sequence: Synthetic oligonucleotide
cauagaauaaaauauauaaau

SEQ ID NO: 28489 - RNA, 21 nt, Artificial Sequence
  Description of Artificial Sequence: Synthetic oligonucleotide
acauagaauaaaauauauaaa

SEQ ID NO: 28490 - RNA, 21 nt, Artificial Sequence
  Description of Artificial Sequence: Synthetic oligonucleotide
cacauagaauaaaauauauaa

SEQ ID NO: 28491 - RNA, 21 nt, Artificial Sequence
  Description of Artificial Sequence: Synthetic oligonucleotide
acacauagaauaaaauauaua

SEQ ID NO: 28492 - RNA, 21 nt, Artificial Sequence
  Description of Artificial Sequence: Synthetic oligonucleotide
aacacauagaauaaaauauau

SEQ ID NO: 28493 - RNA, 21 nt, Artificial Sequence
  Description of Artificial Sequence: Synthetic oligonucleotide
gaacacauagaauaaaauaua

SEQ ID NO: 28494 - RNA, 21 nt, Artificial Sequence
  Description of Artificial Sequence: Synthetic oligonucleotide
ggaacacauagaauaaaauau

SEQ ID NO: 28495 - RNA, 21 nt, Artificial Sequence
  Description of Artificial Sequence: Synthetic oligonucleotide
uggaacacauagaauaaaaua

SEQ ID NO: 28496 - RNA, 21 nt, Artificial Sequence
  Description of Artificial Sequence: Synthetic oligonucleotide
auggaacacauagaauaaaau

SEQ ID NO: 28497 - RNA, 21 nt, Artificial Sequence
  Description of Artificial Sequence: Synthetic oligonucleotide
uauggaacacauagaauaaaa

SEQ ID NO: 28498 - RNA, 21 nt, Artificial Sequence
  Description of Artificial Sequence: Synthetic oligonucleotide
cuauggaacacauagaauaaa

SEQ ID NO: 28499 - RNA, 21 nt, Artificial Sequence
  Description of Artificial Sequence: Synthetic oligonucleotide
ucuauggaacacauagaauaa

SEQ ID NO: 28500 - RNA, 21 nt, Artificial Sequence
  Description of Artificial Sequence: Synthetic oligonucleotide
aucuauggaacacauagaaua

SEQ ID NO: 28501 - RNA, 21 nt, Artificial Sequence
  Description of Artificial Sequence: Synthetic oligonucleotide
uaucuauggaacacauagaau

SEQ ID NO: 28502 - RNA, 21 nt, Artificial Sequence
  Description of Artificial Sequence: Synthetic oligonucleotide
auaucuauggaacacauagaa

SEQ ID NO: 28503 - RNA, 21 nt, Artificial Sequence
  Description of Artificial Sequence: Synthetic oligonucleotide
gauaucuauggaacacauaga

SEQ ID NO: 28504 - RNA, 21 nt, Artificial Sequence
  Description of Artificial Sequence: Synthetic oligonucleotide
agauaucuauggaacacauag

SEQ ID NO: 28505 - RNA, 21 nt, Artificial Sequence
  Description of Artificial Sequence: Synthetic oligonucleotide
aagauaucuauggaacacaua

SEQ ID NO: 28506 - RNA, 21 nt, Artificial Sequence
  Description of Artificial Sequence: Synthetic oligonucleotide
uaagauaucuauggaacacau

SEQ ID NO: 28507 - RNA, 21 nt, Artificial Sequence
  Description of Artificial Sequence: Synthetic oligonucleotide
uuaagauaucuauggaacaca

SEQ ID NO: 28508 - RNA, 21 nt, Artificial Sequence
  Description of Artificial Sequence: Synthetic oligonucleotide
auuaagauaucuauggaacac

SEQ ID NO: 28509 - RNA, 21 nt, Artificial Sequence
  Description of Artificial Sequence: Synthetic oligonucleotide
cauuaagauaucuauggaaca

SEQ ID NO: 28510 - RNA, 21 nt, Artificial Sequence
  Description of Artificial Sequence: Synthetic oligonucleotide
acauuaagauaucuauggaac

SEQ ID NO: 28511 - RNA, 21 nt, Artificial Sequence
  Description of Artificial Sequence: Synthetic oligonucleotide
uacauuaagauaucuauggaa

SEQ ID NO: 28512 - RNA, 21 nt, Artificial Sequence
  Description of Artificial Sequence: Synthetic oligonucleotide
uuacauuaagauaucuaugga

SEQ ID NO: 28513 - RNA, 21 nt, Artificial Sequence
  Description of Artificial Sequence: Synthetic oligonucleotide
uuuacauuaagauaucuaugg

SEQ ID NO: 28514 - RNA, 21 nt, Artificial Sequence
  Description of Artificial Sequence: Synthetic oligonucleotide
uuuuacauuaagauaucuaug

SEQ ID NO: 28515 - RNA, 21 nt, Artificial Sequence
  Description of Artificial Sequence: Synthetic oligonucleotide
auuuuacauuaagauaucuau

SEQ ID NO: 28516 - RNA, 21 nt, Artificial Sequence
  Description of Artificial Sequence: Synthetic oligonucleotide
aauuuuacauuaagauaucua

SEQ ID NO: 28517 - RNA, 21 nt, Artificial Sequence
  Description of Artificial Sequence: Synthetic oligonucleotide
uaauuuuacauuaagauaucu

SEQ ID NO: 28518 - RNA, 21 nt, Artificial Sequence
  Description of Artificial Sequence: Synthetic oligonucleotide
cuaauuuuacauuaagauauc

SEQ ID NO: 28519 - RNA, 21 nt, Artificial Sequence
  Description of Artificial Sequence: Synthetic oligonucleotide
acuaauuuuacauuaagauau

SEQ ID NO: 28520 - RNA, 21 nt, Artificial Sequence
  Description of Artificial Sequence: Synthetic oligonucleotide
gacuaauuuuacauuaagaua

SEQ ID NO: 28521 - RNA, 21 nt, Artificial Sequence
  Description of Artificial Sequence: Synthetic oligonucleotide
ugacuaauuuuacauuaagau

SEQ ID NO: 28522 - RNA, 21 nt, Artificial Sequence
  Description of Artificial Sequence: Synthetic oligonucleotide
augacuaauuuuacauuaaga

SEQ ID NO: 28523 - RNA, 21 nt, Artificial Sequence
  Description of Artificial Sequence: Synthetic oligonucleotide
aaugacuaauuuuacauuaag

SEQ ID NO: 28524 - RNA, 21 nt, Artificial Sequence
  Description of Artificial Sequence: Synthetic oligonucleotide
aaaugacuaauuuuacauuaa

SEQ ID NO: 28525 - RNA, 21 nt, Artificial Sequence
  Description of Artificial Sequence: Synthetic oligonucleotide
uaaaugacuaauuuuacauua

SEQ ID NO: 28526 - RNA, 21 nt, Artificial Sequence
  Description of Artificial Sequence: Synthetic oligonucleotide
uuaaaugacuaauuuuacauu

SEQ ID NO: 28527 - RNA, 21 nt, Artificial Sequence
  Description of Artificial Sequence: Synthetic oligonucleotide
uuuaaaugacuaauuuuacau

SEQ ID NO: 28528 - RNA, 21 nt, Artificial Sequence
  Description of Artificial Sequence: Synthetic oligonucleotide
auuuaaaugacuaauuuuaca

SEQ ID NO: 28529 - RNA, 21 nt, Artificial Sequence
  Description of Artificial Sequence: Synthetic oligonucleotide
aauuuaaaugacuaauuuuac

SEQ ID NO: 28530 - RNA, 21 nt, Artificial Sequence
  Description of Artificial Sequence: Synthetic oligonucleotide
uaauuuaaaugacuaauuuua

SEQ ID NO: 28531 - RNA, 21 nt, Artificial Sequence
  Description of Artificial Sequence: Synthetic oligonucleotide
guaauuuaaaugacuaauuuu

SEQ ID NO: 28532 - RNA, 21 nt, Artificial Sequence
  Description of Artificial Sequence: Synthetic oligonucleotide
uguaauuuaaaugacuaauuu

SEQ ID NO: 28533 - RNA, 21 nt, Artificial Sequence
  Description of Artificial Sequence: Synthetic oligonucleotide
guguaauuuaaaugacuaauu

SEQ ID NO: 28534 - RNA, 21 nt, Artificial Sequence
  Description of Artificial Sequence: Synthetic oligonucleotide
aguguaauuuaaaugacuaau

SEQ ID NO: 28535 - RNA, 21 nt, Artificial Sequence
  Description of Artificial Sequence: Synthetic oligonucleotide
caguguaauuuaaaugacuaa

SEQ ID NO: 28536 - RNA, 21 nt, Artificial Sequence
  Description of Artificial Sequence: Synthetic oligonucleotide
acaguguaauuuaaaugacua

SEQ ID NO: 28537 - RNA, 21 nt, Artificial Sequence
  Description of Artificial Sequence: Synthetic oligonucleotide
gacaguguaauuuaaaugacu

SEQ ID NO: 28538 - RNA, 21 nt, Artificial Sequence
  Description of Artificial Sequence: Synthetic oligonucleotide
ugacaguguaauuuaaaugac

SEQ ID NO: 28539 - RNA, 21 nt, Artificial Sequence
  Description of Artificial Sequence: Synthetic oligonucleotide
uugacaguguaauuuaaauga

SEQ ID NO: 28540 - RNA, 21 nt, Artificial Sequence
  Description of Artificial Sequence: Synthetic oligonucleotide
auugacaguguaauuuaaaug

SEQ ID NO: 28541 - RNA, 21 nt, Artificial Sequence
  Description of Artificial Sequence: Synthetic oligonucleotide
aauugacaguguaauuuaaau

SEQ ID NO: 28542 - RNA, 21 nt, Artificial Sequence
  Description of Artificial Sequence: Synthetic oligonucleotide
uaauugacaguguaauuuaaa

SEQ ID NO: 28543 - RNA, 21 nt, Artificial Sequence
  Description of Artificial Sequence: Synthetic oligonucleotide
uuaauugacaguguaauuuaa

SEQ ID NO: 28544 - RNA, 21 nt, Artificial Sequence
  Description of Artificial Sequence: Synthetic oligonucleotide
uuuaauugacaguguaauuua

SEQ ID NO: 28545 - RNA, 21 nt, Artificial Sequence
  Description of Artificial Sequence: Synthetic oligonucleotide
uuuuaauugacaguguaauuu

SEQ ID NO: 28546 - RNA, 21 nt, Artificial Sequence
  Description of Artificial Sequence: Synthetic oligonucleotide
cuuuuaauugacaguguaauu

SEQ ID NO: 28547 - RNA, 21 nt, Artificial Sequence
  Description of Artificial Sequence: Synthetic oligonucleotide
acuuuuaauugacaguguaau

SEQ ID NO: 28548 - RNA, 21 nt, Artificial Sequence
  Description of Artificial Sequence: Synthetic oligonucleotide
uacuuuuaauugacaguguaa

SEQ ID NO: 28549 - RNA, 21 nt, Artificial Sequence
  Description of Artificial Sequence: Synthetic oligonucleotide
uuacuuuuaauugacagugua

SEQ ID NO: 28550 - RNA, 21 nt, Artificial Sequence
  Description of Artificial Sequence: Synthetic oligonucleotide
auuacuuuuaauugacagugu

SEQ ID NO: 28551 - RNA, 21 nt, Artificial Sequence
  Description of Artificial Sequence: Synthetic oligonucleotide
cauuacuuuuaauugacagug

SEQ ID NO: 28552 - RNA, 21 nt, Artificial Sequence
  Description of Artificial Sequence: Synthetic oligonucleotide
ccauuacuuuuaauugacagu

SEQ ID NO: 28553 - RNA, 21 nt, Artificial Sequence
  Description of Artificial Sequence: Synthetic oligonucleotide
cccauuacuuuuaauugacag

SEQ ID NO: 28554 - RNA, 21 nt, Artificial Sequence
  Description of Artificial Sequence: Synthetic oligonucleotide
gcccauuacuuuuaauugaca

SEQ ID NO: 28555 - RNA, 21 nt, Artificial Sequence
  Description of Artificial Sequence: Synthetic oligonucleotide
ugcccauuacuuuuaauugac

SEQ ID NO: 28556 - RNA, 21 nt, Artificial Sequence
  Description of Artificial Sequence: Synthetic oligonucleotide
uugcccauuacuuuuaauuga

SEQ ID NO: 28557 - RNA, 21 nt, Artificial Sequence
  Description of Artificial Sequence: Synthetic oligonucleotide
cuugcccauuacuuuuaauug

SEQ ID NO: 28558 - RNA, 21 nt, Artificial Sequence
  Description of Artificial Sequence: Synthetic oligonucleotide
ucuugcccauuacuuuuaauu

SEQ ID NO: 28559 - RNA, 21 nt, Artificial Sequence
  Description of Artificial Sequence: Synthetic oligonucleotide
cucuugcccauuacuuuuaau

SEQ ID NO: 28560 - RNA, 21 nt, Artificial Sequence
  Description of Artificial Sequence: Synthetic oligonucleotide
ucucuugcccauuacuuuuaa

SEQ ID NO: 28561 - RNA, 21 nt, Artificial Sequence
  Description of Artificial Sequence: Synthetic oligonucleotide
aucucuugcccauuacuuuua

SEQ ID NO: 28562 - RNA, 21 nt, Artificial Sequence
  Description of Artificial Sequence: Synthetic oligonucleotide
aaucucuugcccauuacuuuu

SEQ ID NO: 28563 - RNA, 21 nt, Artificial Sequence
  Description of Artificial Sequence: Synthetic oligonucleotide
caaucucuugcccauuacuuu

SEQ ID NO: 28564 - RNA, 21 nt, Artificial Sequence
  Description of Artificial Sequence: Synthetic oligonucleotide
gcaaucucuugcccauuacuu

SEQ ID NO: 28565 - RNA, 21 nt, Artificial Sequence
  Description of Artificial Sequence: Synthetic oligonucleotide
ugcaaucucuugcccauuacu

SEQ ID NO: 28566 - RNA, 21 nt, Artificial Sequence
  Description of Artificial Sequence: Synthetic oligonucleotide
augcaaucucuugcccauuac

SEQ ID NO: 28567 - RNA, 21 nt, Artificial Sequence
  Description of Artificial Sequence: Synthetic oligonucleotide
gaugcaaucucuugcccauua

SEQ ID NO: 28568 - RNA, 21 nt, Artificial Sequence
  Description of Artificial Sequence: Synthetic oligonucleotide
ugaugcaaucucuugcccauu

SEQ ID NO: 28569 - RNA, 21 nt, Artificial Sequence
  Description of Artificial Sequence: Synthetic oligonucleotide
augaugcaaucucuugcccau

SEQ ID NO: 28570 - RNA, 21 nt, Artificial Sequence
  Description of Artificial Sequence: Synthetic oligonucleotide
uaugaugcaaucucuugccca

SEQ ID NO: 28571 - RNA, 21 nt, Artificial Sequence
  Description of Artificial Sequence: Synthetic oligonucleotide
guaugaugcaaucucuugccc

SEQ ID NO: 28572 - RNA, 21 nt, Artificial Sequence
  Description of Artificial Sequence: Synthetic oligonucleotide
aguaugaugcaaucucuugcc

SEQ ID NO: 28573 - RNA, 21 nt, Artificial Sequence
  Description of Artificial Sequence: Synthetic oligonucleotide
uaguaugaugcaaucucuugc

SEQ ID NO: 28574 - RNA, 21 nt, Artificial Sequence
  Description of Artificial Sequence: Synthetic oligonucleotide
uuaguaugaugcaaucucuug

SEQ ID NO: 28575 - RNA, 21 nt, Artificial Sequence
  Description of Artificial Sequence: Synthetic oligonucleotide
auuaguaugaugcaaucucuu

SEQ ID NO: 28576 - RNA, 21 nt, Artificial Sequence
  Description of Artificial Sequence: Synthetic oligonucleotide
aauuaguaugaugcaaucucu

SEQ ID NO: 28577 - RNA, 21 nt, Artificial Sequence
  Description of Artificial Sequence: Synthetic oligonucleotide
aaauuaguaugaugcaaucuc

SEQ ID NO: 28578 - RNA, 21 nt, Artificial Sequence
  Description of Artificial Sequence: Synthetic oligonucleotide
uaaauuaguaugaugcaaucu

SEQ ID NO: 28579 - RNA, 21 nt, Artificial Sequence
  Description of Artificial Sequence: Synthetic oligonucleotide
cuaaauuaguaugaugcaauc

SEQ ID NO: 28580 - RNA, 21 nt, Artificial Sequence
  Description of Artificial Sequence: Synthetic oligonucleotide
acuaaauuaguaugaugcaau

SEQ ID NO: 28581 - RNA, 21 nt, Artificial Sequence
  Description of Artificial Sequence: Synthetic oligonucleotide
uacuaaauuaguaugaugcaa

SEQ ID NO: 28582 - RNA, 21 nt, Artificial Sequence
  Description of Artificial Sequence: Synthetic oligonucleotide
uuacuaaauuaguaugaugca

SEQ ID NO: 28583 - RNA, 21 nt, Artificial Sequence
  Description of Artificial Sequence: Synthetic oligonucleotide
cuuacuaaauuaguaugaugc

SEQ ID NO: 28584 - RNA, 21 nt, Artificial Sequence
  Description of Artificial Sequence: Synthetic oligonucleotide
ucuuacuaaauuaguaugaug

SEQ ID NO: 28585 - RNA, 21 nt, Artificial Sequence
  Description of Artificial Sequence: Synthetic oligonucleotide
uucuuacuaaauuaguaugau

SEQ ID NO: 28586 - RNA, 21 nt, Artificial Sequence
  Description of Artificial Sequence: Synthetic oligonucleotide
guucuuacuaaauuaguauga

SEQ ID NO: 28587 - RNA, 21 nt, Artificial Sequence
  Description of Artificial Sequence: Synthetic oligonucleotide
cguucuuacuaaauuaguaug

SEQ ID NO: 28588 - RNA, 21 nt, Artificial Sequence
  Description of Artificial Sequence: Synthetic oligonucleotide
acguucuuacuaaauuaguau

SEQ ID NO: 28589 - RNA, 21 nt, Artificial Sequence
  Description of Artificial Sequence: Synthetic oligonucleotide
aacguucuuacuaaauuagua

SEQ ID NO: 28590 - RNA, 21 nt, Artificial Sequence
  Description of Artificial Sequence: Synthetic oligonucleotide
gaacguucuuacuaaauuagu

SEQ ID NO: 28591 - RNA, 21 nt, Artificial Sequence
  Description of Artificial Sequence: Synthetic oligonucleotide
ggaacguucuuacuaaauuag

SEQ ID NO: 28592 - RNA, 21 nt, Artificial Sequence
  Description of Artificial Sequence: Synthetic oligonucleotide
gggaacguucuuacuaaauua

SEQ ID NO: 28593 - RNA, 21 nt, Artificial Sequence
  Description of Artificial Sequence: Synthetic oligonucleotide
ugggaacguucuuacuaaauu

SEQ ID NO: 28594 - RNA, 21 nt, Artificial Sequence
  Description of Artificial Sequence: Synthetic oligonucleotide
uugggaacguucuuacuaaau

SEQ ID NO: 28595 - RNA, 21 nt, Artificial Sequence
  Description of Artificial Sequence: Synthetic oligonucleotide
uuugggaacguucuuacuaaa

SEQ ID NO: 28596 - RNA, 21 nt, Artificial Sequence
  Description of Artificial Sequence: Synthetic oligonucleotide
auuugggaacguucuuacuaa

SEQ ID NO: 28597 - RNA, 21 nt, Artificial Sequence
  Description of Artificial Sequence: Synthetic oligonucleotide
cauuugggaacguucuuacua

SEQ ID NO: 28598 - RNA, 21 nt, Artificial Sequence
  Description of Artificial Sequence: Synthetic oligonucleotide
acauuugggaacguucuuacu

SEQ ID NO: 28599 - RNA, 21 nt, Artificial Sequence
  Description of Artificial Sequence: Synthetic oligonucleotide
aacauuugggaacguucuuac

SEQ ID NO: 28600 - RNA, 21 nt, Artificial Sequence
  Description of Artificial Sequence: Synthetic oligonucleotide
caacauuugggaacguucuua

SEQ ID NO: 28601 - RNA, 21 nt, Artificial Sequence
  Description of Artificial Sequence: Synthetic oligonucleotide
acaacauuugggaacguucuu

SEQ ID NO: 28602 - RNA, 21 nt, Artificial Sequence
  Description of Artificial Sequence: Synthetic oligonucleotide
uacaacauuugggaacguucu

SEQ ID NO: 28603 - RNA, 21 nt, Artificial Sequence
  Description of Artificial Sequence: Synthetic oligonucleotide
uuacaacauuugggaacguuc

SEQ ID NO: 28604 - RNA, 21 nt, Artificial Sequence
  Description of Artificial Sequence: Synthetic oligonucleotide
guuacaacauuugggaacguu

SEQ ID NO: 28605 - RNA, 21 nt, Artificial Sequence
  Description of Artificial Sequence: Synthetic oligonucleotide
uguuacaacauuugggaacgu

SEQ ID NO: 28606 - RNA, 21 nt, Artificial Sequence
  Description of Artificial Sequence: Synthetic oligonucleotide
uuguuacaacauuugggaacg

SEQ ID NO: 28607 - RNA, 21 nt, Artificial Sequence
  Description of Artificial Sequence: Synthetic oligonucleotide
auuguuacaacauuugggaac

SEQ ID NO: 28608 - RNA, 21 nt, Artificial Sequence
  Description of Artificial Sequence: Synthetic oligonucleotide
cauuguuacaacauuugggaa

SEQ ID NO: 28609 - RNA, 21 nt, Artificial Sequence
  Description of Artificial Sequence: Synthetic oligonucleotide
acauuguuacaacauuuggga

SEQ ID NO: 28610 - RNA, 21 nt, Artificial Sequence
  Description of Artificial Sequence: Synthetic oligonucleotide
cacauuguuacaacauuuggg

SEQ ID NO: 28611 - RNA, 21 nt, Artificial Sequence
  Description of Artificial Sequence: Synthetic oligonucleotide
ccacauuguuacaacauuugg

SEQ ID NO: 28612 - RNA, 21 nt, Artificial Sequence
  Description of Artificial Sequence: Synthetic oligonucleotide
uccacauuguuacaacauuug

SEQ ID NO: 28613 - RNA, 21 nt, Artificial Sequence
  Description of Artificial Sequence: Synthetic oligonucleotide
auccacauuguuacaacauuu

SEQ ID NO: 28614 - RNA, 21 nt, Artificial Sequence
  Description of Artificial Sequence: Synthetic oligonucleotide
gauccacauuguuacaacauu

SEQ ID NO: 28615 - RNA, 21 nt, Artificial Sequence
  Description of Artificial Sequence: Synthetic oligonucleotide
ugauccacauuguuacaacau

SEQ ID NO: 28616 - RNA, 21 nt, Artificial Sequence
  Description of Artificial Sequence: Synthetic oligonucleotide
augauccacauuguuacaaca

SEQ ID NO: 28617 - RNA, 21 nt, Artificial Sequence
  Description of Artificial Sequence: Synthetic oligonucleotide
uaugauccacauuguuacaac

SEQ ID NO: 28618 - RNA, 21 nt, Artificial Sequence
  Description of Artificial Sequence: Synthetic oligonucleotide
guaugauccacauuguuacaa

SEQ ID NO: 28619 - RNA, 21 nt, Artificial Sequence
  Description of Artificial Sequence: Synthetic oligonucleotide
uguaugauccacauuguuaca

SEQ ID NO: 28620 - RNA, 21 nt, Artificial Sequence
  Description of Artificial Sequence: Synthetic oligonucleotide
auguaugauccacauuguuac

SEQ ID NO: 28621 - RNA, 21 nt, Artificial Sequence
  Description of Artificial Sequence: Synthetic oligonucleotide
gauguaugauccacauuguua

SEQ ID NO: 28622 - RNA, 21 nt, Artificial Sequence
  Description of Artificial Sequence: Synthetic oligonucleotide
agauguaugauccacauuguu

SEQ ID NO: 28623 - RNA, 21 nt, Artificial Sequence
  Description of Artificial Sequence: Synthetic oligonucleotide
gagauguaugauccacauugu

SEQ ID NO: 28624 - RNA, 21 nt, Artificial Sequence
  Description of Artificial Sequence: Synthetic oligonucleotide
agagauguaugauccacauug

SEQ ID NO: 28625 - RNA, 21 nt, Artificial Sequence
  Description of Artificial Sequence: Synthetic oligonucleotide
cagagauguaugauccacauu

SEQ ID NO: 28626 - RNA, 21 nt, Artificial Sequence
  Description of Artificial Sequence: Synthetic oligonucleotide
ccagagauguaugauccacau

SEQ ID NO: 28627 - RNA, 21 nt, Artificial Sequence
  Description of Artificial Sequence: Synthetic oligonucleotide
accagagauguaugauccaca

SEQ ID NO: 28628 - RNA, 21 nt, Artificial Sequence
  Description of Artificial Sequence: Synthetic oligonucleotide
aaccagagauguaugauccac

SEQ ID NO: 28629 - RNA, 21 nt, Artificial Sequence
  Description of Artificial Sequence: Synthetic oligonucleotide
aaaccagagauguaugaucca

SEQ ID NO: 28630 - RNA, 21 nt, Artificial Sequence
  Description of Artificial Sequence: Synthetic oligonucleotide
aaaaccagagauguaugaucc

SEQ ID NO: 28631 - RNA, 21 nt, Artificial Sequence
  Description of Artificial Sequence: Synthetic oligonucleotide
aaaaaccagagauguaugauc

SEQ ID NO: 28632 - RNA, 21 nt, Artificial Sequence
  Description of Artificial Sequence: Synthetic oligonucleotide
aaaaaaccagagauguaugau

SEQ ID NO: 28633 - RNA, 21 nt, Artificial Sequence
  Description of Artificial Sequence: Synthetic oligonucleotide
uaaaaaaccagagauguauga

SEQ ID NO: 28634 - RNA, 21 nt, Artificial Sequence
  Description of Artificial Sequence: Synthetic oligonucleotide
uuaaaaaaccagagauguaug

SEQ ID NO: 28635 - RNA, 21 nt, Artificial Sequence
  Description of Artificial Sequence: Synthetic oligonucleotide
uuuaaaaaaccagagauguau

SEQ ID NO: 28636 - RNA, 21 nt, Artificial Sequence
  Description of Artificial Sequence: Synthetic oligonucleotide
auuuaaaaaaccagagaugua

SEQ ID NO: 28637 - RNA, 21 nt, Artificial Sequence
  Description of Artificial Sequence: Synthetic oligonucleotide
cauuuaaaaaaccagagaugu

SEQ ID NO: 28638 - RNA, 21 nt, Artificial Sequence
  Description of Artificial Sequence: Synthetic oligonucleotide
acauuuaaaaaaccagagaug

SEQ ID NO: 28639 - RNA, 21 nt, Artificial Sequence
  Description of Artificial Sequence: Synthetic oligonucleotide
uacauuuaaaaaaccagagau

SEQ ID NO: 28640 - RNA, 21 nt, Artificial Sequence
  Description of Artificial Sequence: Synthetic oligonucleotide
auacauuuaaaaaaccagaga

SEQ ID NO: 28641 - RNA, 21 nt, Artificial Sequence
  Description of Artificial Sequence: Synthetic oligonucleotide
aauacauuuaaaaaaccagag

SEQ ID NO: 28642 - RNA, 21 nt, Artificial Sequence
  Description of Artificial Sequence: Synthetic oligonucleotide
caauacauuuaaaaaaccaga

SEQ ID NO: 28643 - RNA, 21 nt, Artificial Sequence
  Description of Artificial Sequence: Synthetic oligonucleotide
ucaauacauuuaaaaaaccag

SEQ ID NO: 28644 - RNA, 21 nt, Artificial Sequence
  Description of Artificial Sequence: Synthetic oligonucleotide
cucaauacauuuaaaaaacca

SEQ ID NO: 28645 - RNA, 21 nt, Artificial Sequence
  Description of Artificial Sequence: Synthetic oligonucleotide
ccucaauacauuuaaaaaacc

SEQ ID NO: 28646 - RNA, 21 nt, Artificial Sequence
  Description of Artificial Sequence: Synthetic oligonucleotide
gccucaauacauuuaaaaaac

SEQ ID NO: 28647 - RNA, 21 nt, Artificial Sequence
  Description of Artificial Sequence: Synthetic oligonucleotide
agccucaauacauuuaaaaaa

SEQ ID NO: 28648 - RNA, 21 nt, Artificial Sequence
  Description of Artificial Sequence: Synthetic oligonucleotide
aagccucaauacauuuaaaaa

SEQ ID NO: 28649 - RNA, 21 nt, Artificial Sequence
  Description of Artificial Sequence: Synthetic oligonucleotide
aaagccucaauacauuuaaaa

SEQ ID NO: 28650 - RNA, 21 nt, Artificial Sequence
  Description of Artificial Sequence: Synthetic oligonucleotide
gaaagccucaauacauuuaaa

SEQ ID NO: 28651 - RNA, 21 nt, Artificial Sequence
  Description of Artificial Sequence: Synthetic oligonucleotide
agaaagccucaauacauuuaa

SEQ ID NO: 28652 - RNA, 21 nt, Artificial Sequence
  Description of Artificial Sequence: Synthetic oligonucleotide
aagaaagccucaauacauuua

SEQ ID NO: 28653 - RNA, 21 nt, Artificial Sequence
  Description of Artificial Sequence: Synthetic oligonucleotide
caagaaagccucaauacauuu

SEQ ID NO: 28654 - RNA, 21 nt, Artificial Sequence
  Description of Artificial Sequence: Synthetic oligonucleotide
ccaagaaagccucaauacauu

SEQ ID NO: 28655 - RNA, 21 nt, Artificial Sequence
  Description of Artificial Sequence: Synthetic oligonucleotide
accaagaaagccucaauacau

SEQ ID NO: 28656 - RNA, 21 nt, Artificial Sequence
  Description of Artificial Sequence: Synthetic oligonucleotide
caccaagaaagccucaauaca

SEQ ID NO: 28657 - RNA, 21 nt, Artificial Sequence
  Description of Artificial Sequence: Synthetic oligonucleotide
ccaccaagaaagccucaauac

SEQ ID NO: 28658 - RNA, 21 nt, Artificial Sequence
  Description of Artificial Sequence: Synthetic oligonucleotide
uccaccaagaaagccucaaua

SEQ ID NO: 28659 - RNA, 21 nt, Artificial Sequence
  Description of Artificial Sequence: Synthetic oligonucleotide
guccaccaagaaagccucaau

SEQ ID NO: 28660 - RNA, 21 nt, Artificial Sequence
  Description of Artificial Sequence: Synthetic oligonucleotide
aguccaccaagaaagccucaa

SEQ ID NO: 28661 - RNA, 21 nt, Artificial Sequence
  Description of Artificial Sequence: Synthetic oligonucleotide
uaguccaccaagaaagccuca

SEQ ID NO: 28662 - RNA, 21 nt, Artificial Sequence
  Description of Artificial Sequence: Synthetic oligonucleotide
cuaguccaccaagaaagccuc

SEQ ID NO: 28663 - RNA, 21 nt, Artificial Sequence
  Description of Artificial Sequence: Synthetic oligonucleotide
acuaguccaccaagaaagccu

SEQ ID NO: 28664 - RNA, 21 nt, Artificial Sequence
  Description of Artificial Sequence: Synthetic oligonucleotide
uacuaguccaccaagaaagcc

SEQ ID NO: 28665 - RNA, 21 nt, Artificial Sequence
  Description of Artificial Sequence: Synthetic oligonucleotide
auacuaguccaccaagaaagc

SEQ ID NO: 28666 - RNA, 21 nt, Artificial Sequence
  Description of Artificial Sequence: Synthetic oligonucleotide
uauacuaguccaccaagaaag

SEQ ID NO: 28667 - RNA, 21 nt, Artificial Sequence
  Description of Artificial Sequence: Synthetic oligonucleotide
cuauacuaguccaccaagaaa

SEQ ID NO: 28668 - RNA, 21 nt, Artificial Sequence
  Description of Artificial Sequence: Synthetic oligonucleotide
acuauacuaguccaccaagaa

SEQ ID NO: 28669 - RNA, 21 nt, Artificial Sequence
  Description of Artificial Sequence: Synthetic oligonucleotide
uacuauacuaguccaccaaga

SEQ ID NO: 28670 - RNA, 21 nt, Artificial Sequence
  Description of Artificial Sequence: Synthetic oligonucleotide
auacuauacuaguccaccaag

SEQ ID NO: 28671 - RNA, 21 nt, Artificial Sequence
  Description of Artificial Sequence: Synthetic oligonucleotide
uauacuauacuaguccaccaa

SEQ ID NO: 28672 - RNA, 21 nt, Artificial Sequence
  Description of Artificial Sequence: Synthetic oligonucleotide
guauacuauacuaguccacca

SEQ ID NO: 28673 - RNA, 21 nt, Artificial Sequence
  Description of Artificial Sequence: Synthetic oligonucleotide
cguauacuauacuaguccacc

SEQ ID NO: 28674 - RNA, 21 nt, Artificial Sequence
  Description of Artificial Sequence: Synthetic oligonucleotide
ccguauacuauacuaguccac

SEQ ID NO: 28675 - RNA, 21 nt, Artificial Sequence
  Description of Artificial Sequence: Synthetic oligonucleotide
accguauacuauacuagucca

SEQ ID NO: 28676 - RNA, 21 nt, Artificial Sequence
  Description of Artificial Sequence: Synthetic oligonucleotide
gaccguauacuauacuagucc

SEQ ID NO: 28677 - RNA, 21 nt, Artificial Sequence
  Description of Artificial Sequence: Synthetic oligonucleotide
ugaccguauacuauacuaguc

SEQ ID NO: 28678 - RNA, 21 nt, Artificial Sequence
  Description of Artificial Sequence: Synthetic oligonucleotide
cugaccguauacuauacuagu

SEQ ID NO: 28679 - RNA, 21 nt, Artificial Sequence
  Description of Artificial Sequence: Synthetic oligonucleotide
acugaccguauacuauacuag

SEQ ID NO: 28680 - RNA, 21 nt, Artificial Sequence
  Description of Artificial Sequence: Synthetic oligonucleotide
aacugaccguauacuauacua

SEQ ID NO: 28681 - RNA, 21 nt, Artificial Sequence
  Description of Artificial Sequence: Synthetic oligonucleotide
uaacugaccguauacuauacu

SEQ ID NO: 28682 - RNA, 21 nt, Artificial Sequence
  Description of Artificial Sequence: Synthetic oligonucleotide
auaacugaccguauacuauac

SEQ ID NO: 28683 - RNA, 21 nt, Artificial Sequence
  Description of Artificial Sequence: Synthetic oligonucleotide
cauaacugaccguauacuaua

SEQ ID NO: 28684 - RNA, 21 nt, Artificial Sequence
  Description of Artificial Sequence: Synthetic oligonucleotide
acauaacugaccguauacuau

SEQ ID NO: 28685 - RNA, 21 nt, Artificial Sequence
  Description of Artificial Sequence: Synthetic oligonucleotide
gacauaacugaccguauacua

SEQ ID NO: 28686 - RNA, 21 nt, Artificial Sequence
  Description of Artificial Sequence: Synthetic oligonucleotide
ugacauaacugaccguauacu

SEQ ID NO: 28687 - RNA, 21 nt, Artificial Sequence
  Description of Artificial Sequence: Synthetic oligonucleotide
uugacauaacugaccguauac

SEQ ID NO: 28688 - RNA, 21 nt, Artificial Sequence
  Description of Artificial Sequence: Synthetic oligonucleotide
auugacauaacugaccguaua

SEQ ID NO: 28689 - RNA, 21 nt, Artificial Sequence
  Description of Artificial Sequence: Synthetic oligonucleotide
cauugacauaacugaccguau

SEQ ID NO: 28690 - RNA, 21 nt, Artificial Sequence
  Description of Artificial Sequence: Synthetic oligonucleotide
acauugacauaacugaccgua

SEQ ID NO: 28691 - RNA, 21 nt, Artificial Sequence
  Description of Artificial Sequence: Synthetic oligonucleotide
aacauugacauaacugaccgu

SEQ ID NO: 28692 - RNA, 21 nt, Artificial Sequence
  Description of Artificial Sequence: Synthetic oligonucleotide
aaacauugacauaacugaccg

SEQ ID NO: 28693 - RNA, 21 nt, Artificial Sequence
  Description of Artificial Sequence: Synthetic oligonucleotide
gaaacauugacauaacugacc

SEQ ID NO: 28694 - RNA, 21 nt, Artificial Sequence
  Description of Artificial Sequence: Synthetic oligonucleotide
ugaaacauugacauaacugac

SEQ ID NO: 28695 - RNA, 21 nt, Artificial Sequence
  Description of Artificial Sequence: Synthetic oligonucleotide
augaaacauugacauaacuga

SEQ ID NO: 28696 - RNA, 21 nt, Artificial Sequence
  Description of Artificial Sequence: Synthetic oligonucleotide
caugaaacauugacauaacug

SEQ ID NO: 28697 - RNA, 21 nt, Artificial Sequence
  Description of Artificial Sequence: Synthetic oligonucleotide
ccaugaaacauugacauaacu

SEQ ID NO: 28698 - RNA, 21 nt, Artificial Sequence
  Description of Artificial Sequence: Synthetic oligonucleotide
accaugaaacauugacauaac

SEQ ID NO: 28699 - RNA, 21 nt, Artificial Sequence
  Description of Artificial Sequence: Synthetic oligonucleotide
gaccaugaaacauugacauaa

SEQ ID NO: 28700 - RNA, 21 nt, Artificial Sequence
  Description of Artificial Sequence: Synthetic oligonucleotide
ugaccaugaaacauugacaua

SEQ ID NO: 28701 - RNA, 21 nt, Artificial Sequence
  Description of Artificial Sequence: Synthetic oligonucleotide
uugaccaugaaacauugacau

SEQ ID NO: 28702 - RNA, 21 nt, Artificial Sequence
  Description of Artificial Sequence: Synthetic oligonucleotide
auugaccaugaaacauugaca

SEQ ID NO: 28703 - RNA, 21 nt, Artificial Sequence
  Description of Artificial Sequence: Synthetic oligonucleotide
uauugaccaugaaacauugac

SEQ ID NO: 28704 - RNA, 21 nt, Artificial Sequence
  Description of Artificial Sequence: Synthetic oligonucleotide
uuauugaccaugaaacauuga

SEQ ID NO: 28705 - RNA, 21 nt, Artificial Sequence
  Description of Artificial Sequence: Synthetic oligonucleotide
uuuauugaccaugaaacauug

SEQ ID NO: 28706 - RNA, 21 nt, Artificial Sequence
  Description of Artificial Sequence: Synthetic oligonucleotide
uuuuauugaccaugaaacauu

SEQ ID NO: 28707 - RNA, 21 nt, Artificial Sequence
  Description of Artificial Sequence: Synthetic oligonucleotide
uuuuuauugaccaugaaacau

SEQ ID NO: 28708 - RNA, 21 nt, Artificial Sequence
  Description of Artificial Sequence: Synthetic oligonucleotide
cuuuuuauugaccaugaaaca

SEQ ID NO: 28709 - RNA, 21 nt, Artificial Sequence
  Description of Artificial Sequence: Synthetic oligonucleotide
ccuuuuuauugaccaugaaac

SEQ ID NO: 28710 - RNA, 21 nt, Artificial Sequence
  Description of Artificial Sequence: Synthetic oligonucleotide
uccuuuuuauugaccaugaaa

SEQ ID NO: 28711 - RNA, 21 nt, Artificial Sequence
  Description of Artificial Sequence: Synthetic oligonucleotide
uuccuuuuuauugaccaugaa

SEQ ID NO: 28712 - RNA, 21 nt, Artificial Sequence
  Description of Artificial Sequence: Synthetic oligonucleotide
cuuccuuuuuauugaccauga

SEQ ID NO: 28713 - RNA, 21 nt, Artificial Sequence
  Description of Artificial Sequence: Synthetic oligonucleotide
acuuccuuuuuauugaccaug

SEQ ID NO: 28714 - RNA, 21 nt, Artificial Sequence
  Description of Artificial Sequence: Synthetic oligonucleotide
aacuuccuuuuuauugaccau

SEQ ID NO: 28715 - RNA, 21 nt, Artificial Sequence
  Description of Artificial Sequence: Synthetic oligonucleotide
caacuuccuuuuuauugacca

SEQ ID NO: 28716 - RNA, 21 nt, Artificial Sequence
  Description of Artificial Sequence: Synthetic oligonucleotide
gcaacuuccuuuuuauugacc

SEQ ID NO: 28717 - RNA, 21 nt, Artificial Sequence
  Description of Artificial Sequence: Synthetic oligonucleotide
ugcaacuuccuuuuuauugac

SEQ ID NO: 28718 - RNA, 21 nt, Artificial Sequence
  Description of Artificial Sequence: Synthetic oligonucleotide
uugcaacuuccuuuuuauuga

SEQ ID NO: 28719 - RNA, 21 nt, Artificial Sequence
  Description of Artificial Sequence: Synthetic oligonucleotide
uuugcaacuuccuuuuuauug

SEQ ID NO: 28720 - RNA, 21 nt, Artificial Sequence
  Description of Artificial Sequence: Synthetic oligonucleotide
auuugcaacuuccuuuuuauu

SEQ ID NO: 28721 - RNA, 21 nt, Artificial Sequence
  Description of Artificial Sequence: Synthetic oligonucleotide
aauuugcaacuuccuuuuuau

SEQ ID NO: 28722 - RNA, 21 nt, Artificial Sequence
  Description of Artificial Sequence: Synthetic oligonucleotide
caauuugcaacuuccuuuuua

SEQ ID NO: 28723 - RNA, 21 nt, Artificial Sequence
  Description of Artificial Sequence: Synthetic oligonucleotide
acaauuugcaacuuccuuuuu

SEQ ID NO: 28724 - RNA, 21 nt, Artificial Sequence
  Description of Artificial Sequence: Synthetic oligonucleotide
cacaauuugcaacuuccuuuu

SEQ ID NO: 28725 - RNA, 21 nt, Artificial Sequence
  Description of Artificial Sequence: Synthetic oligonucleotide
ucacaauuugcaacuuccuuu

SEQ ID NO: 28726 - RNA, 21 nt, Artificial Sequence
  Description of Artificial Sequence: Synthetic oligonucleotide
gcaggggcguggcgaggguuu

SEQ ID NO: 28727 - RNA, 21 nt, Artificial Sequence
  Description of Artificial Sequence: Synthetic oligonucleotide
agcaggggcguggcgaggguu

SEQ ID NO: 28728 - RNA, 21 nt, Artificial Sequence
  Description of Artificial Sequence: Synthetic oligonucleotide
gagcaggggcguggcgagggu

SEQ ID NO: 28729 - RNA, 21 nt, Artificial Sequence
  Description of Artificial Sequence: Synthetic oligonucleotide
ggagcaggggcguggcgaggg

SEQ ID NO: 28730 - RNA, 21 nt, Artificial Sequence
  Description of Artificial Sequence: Synthetic oligonucleotide
gggagcaggggcguggcgagg

SEQ ID NO: 28731 - RNA, 21 nt, Artificial Sequence
  Description of Artificial Sequence: Synthetic oligonucleotide
ggggagcaggggcguggcgag

SEQ ID NO: 28732 - RNA, 21 nt, Artificial Sequence
  Description of Artificial Sequence: Synthetic oligonucleotide
gggggagcaggggcguggcga

SEQ ID NO: 28733 - RNA, 21 nt, Artificial Sequence
  Description of Artificial Sequence: Synthetic oligonucleotide
cgggggagcaggggcguggcg

SEQ ID NO: 28734 - RNA, 21 nt, Artificial Sequence
  Description of Artificial Sequence: Synthetic oligonucleotide
gcgggggagcaggggcguggc

SEQ ID NO: 28735 - RNA, 21 nt, Artificial Sequence
  Description of Artificial Sequence: Synthetic oligonucleotide
cgcgggggagcaggggcgugg

SEQ ID NO: 28736 - RNA, 21 nt, Artificial Sequence
  Description of Artificial Sequence: Synthetic oligonucleotide
ccgcgggggagcaggggcgug

SEQ ID NO: 28737 - RNA, 21 nt, Artificial Sequence
  Description of Artificial Sequence: Synthetic oligonucleotide
accgcgggggagcaggggcgu

SEQ ID NO: 28738 - RNA, 21 nt, Artificial Sequence
  Description of Artificial Sequence: Synthetic oligonucleotide
aaccgcgggggagcaggggcg

SEQ ID NO: 28739 - RNA, 21 nt, Artificial Sequence
  Description of Artificial Sequence: Synthetic oligonucleotide
caaccgcgggggagcaggggc

SEQ ID NO: 28740 - RNA, 21 nt, Artificial Sequence
  Description of Artificial Sequence: Synthetic oligonucleotide
ccaaccgcgggggagcagggg

SEQ ID NO: 28741 - RNA, 21 nt, Artificial Sequence
  Description of Artificial Sequence: Synthetic oligonucleotide
accaaccgcgggggagcaggg

SEQ ID NO: 28742 - RNA, 21 nt, Artificial Sequence
  Description of Artificial Sequence: Synthetic oligonucleotide
aaccaaccgcgggggagcagg

SEQ ID NO: 28743 - RNA, 21 nt, Artificial Sequence
  Description of Artificial Sequence: Synthetic oligonucleotide
gaaccaaccgcgggggagcag

SEQ ID NO: 28744 - RNA, 21 nt, Artificial Sequence
  Description of Artificial Sequence: Synthetic oligonucleotide
agaaccaaccgcgggggagca

SEQ ID NO: 28745 - RNA, 21 nt, Artificial Sequence
  Description of Artificial Sequence: Synthetic oligonucleotide
aagaaccaaccgcgggggagc

SEQ ID NO: 28746 - RNA, 21 nt, Artificial Sequence
  Description of Artificial Sequence: Synthetic oligonucleotide
gaagaaccaaccgcgggggag

SEQ ID NO: 28747 - RNA, 21 nt, Artificial Sequence
  Description of Artificial Sequence: Synthetic oligonucleotide
ggaagaaccaaccgcggggga

SEQ ID NO: 28748 - RNA, 21 nt, Artificial Sequence
  Description of Artificial Sequence: Synthetic oligonucleotide
aggaagaaccaaccgcggggg

SEQ ID NO: 28749 - RNA, 21 nt, Artificial Sequence
  Description of Artificial Sequence: Synthetic oligonucleotide
aaggaagaaccaaccgcgggg

SEQ ID NO: 28750 - RNA, 21 nt, Artificial Sequence
  Description of Artificial Sequence: Synthetic oligonucleotide
caaggaagaaccaaccgcggg

SEQ ID NO: 28751 - RNA, 21 nt, Artificial Sequence
  Description of Artificial Sequence: Synthetic oligonucleotide
gcaaggaagaaccaaccgcgg

SEQ ID NO: 28752 - RNA, 21 nt, Artificial Sequence
  Description of Artificial Sequence: Synthetic oligonucleotide
agcaaggaagaaccaaccgcg

SEQ ID NO: 28753 - RNA, 21 nt, Artificial Sequence
  Description of Artificial Sequence: Synthetic oligonucleotide
gagcaaggaagaaccaaccgc

SEQ ID NO: 28754 - RNA, 21 nt, Artificial Sequence
  Description of Artificial Sequence: Synthetic oligonucleotide
agagcaaggaagaaccaaccg

SEQ ID NO: 28755 - RNA, 21 nt, Artificial Sequence
  Description of Artificial Sequence: Synthetic oligonucleotide
uagagcaaggaagaaccaacc

SEQ ID NO: 28756 - RNA, 21 nt, Artificial Sequence
  Description of Artificial Sequence: Synthetic oligonucleotide
guagagcaaggaagaaccaac

SEQ ID NO: 28757 - RNA, 21 nt, Artificial Sequence
  Description of Artificial Sequence: Synthetic oligonucleotide
aguagagcaaggaagaaccaa

SEQ ID NO: 28758 - RNA, 21 nt, Artificial Sequence
  Description of Artificial Sequence: Synthetic oligonucleotide
gaguagagcaaggaagaacca

SEQ ID NO: 28759 - RNA, 21 nt, Artificial Sequence
  Description of Artificial Sequence: Synthetic oligonucleotide
ugaguagagcaaggaagaacc

SEQ ID NO: 28760 - RNA, 21 nt, Artificial Sequence
  Description of Artificial Sequence: Synthetic oligonucleotide
uugaguagagcaaggaagaac

SEQ ID NO: 28761 - RNA, 21 nt, Artificial Sequence
  Description of Artificial Sequence: Synthetic oligonucleotide
guugaguagagcaaggaagaa

SEQ ID NO: 28762 - RNA, 21 nt, Artificial Sequence
  Description of Artificial Sequence: Synthetic oligonucleotide
gguugaguagagcaaggaaga

SEQ ID NO: 28763 - RNA, 21 nt, Artificial Sequence
  Description of Artificial Sequence: Synthetic oligonucleotide
ggguugaguagagcaaggaag

SEQ ID NO: 28764 - RNA, 21 nt, Artificial Sequence
  Description of Artificial Sequence: Synthetic oligonucleotide
aggguugaguagagcaaggaa

SEQ ID NO: 28765 - RNA, 21 nt, Artificial Sequence
  Description of Artificial Sequence: Synthetic oligonucleotide
caggguugaguagagcaagga

SEQ ID NO: 28766 - RNA, 21 nt, Artificial Sequence
  Description of Artificial Sequence: Synthetic oligonucleotide
ucaggguugaguagagcaagg

SEQ ID NO: 28767 - RNA, 21 nt, Artificial Sequence
  Description of Artificial Sequence: Synthetic oligonucleotide
gucaggguugaguagagcaag

SEQ ID NO: 28768 - RNA, 21 nt, Artificial Sequence
  Description of Artificial Sequence: Synthetic oligonucleotide
ggucaggguugaguagagcaa

SEQ ID NO: 28769 - RNA, 21 nt, Artificial Sequence
  Description of Artificial Sequence: Synthetic oligonucleotide
aggucaggguugaguagagca

SEQ ID NO: 28770 - RNA, 21 nt, Artificial Sequence
  Description of Artificial Sequence: Synthetic oligonucleotide
gaggucaggguugaguagagc

SEQ ID NO: 28771 - RNA, 21 nt, Artificial Sequence
  Description of Artificial Sequence: Synthetic oligonucleotide
agaggucaggguugaguagag

SEQ ID NO: 28772 - RNA, 21 nt, Artificial Sequence
  Description of Artificial Sequence: Synthetic oligonucleotide
aagaggucaggguugaguaga

SEQ ID NO: 28773 - RNA, 21 nt, Artificial Sequence
  Description of Artificial Sequence: Synthetic oligonucleotide
gaagaggucaggguugaguag

SEQ ID NO: 28774 - RNA, 21 nt, Artificial Sequence
  Description of Artificial Sequence: Synthetic oligonucleotide
agaagaggucaggguugagua

SEQ ID NO: 28775 - RNA, 21 nt, Artificial Sequence
  Description of Artificial Sequence: Synthetic oligonucleotide
gagaagaggucaggguugagu

SEQ ID NO: 28776 - RNA, 21 nt, Artificial Sequence
  Description of Artificial Sequence: Synthetic oligonucleotide
agagaagaggucaggguugag

SEQ ID NO: 28777 - RNA, 21 nt, Artificial Sequence
  Description of Artificial Sequence: Synthetic oligonucleotide
gagagaagaggucaggguuga

SEQ ID NO: 28778 - RNA, 21 nt, Artificial Sequence
  Description of Artificial Sequence: Synthetic oligonucleotide
agagagaagaggucaggguug

SEQ ID NO: 28779 - RNA, 21 nt, Artificial Sequence
  Description of Artificial Sequence: Synthetic oligonucleotide
cagagagaagaggucaggguu

SEQ ID NO: 28780 - RNA, 21 nt, Artificial Sequence
  Description of Artificial Sequence: Synthetic oligonucleotide
ucagagagaagaggucagggu

SEQ ID NO: 28781 - RNA, 21 nt, Artificial Sequence
  Description of Artificial Sequence: Synthetic oligonucleotide
gucagagagaagaggucaggg

SEQ ID NO: 28782 - RNA, 21 nt, Artificial Sequence
  Description of Artificial Sequence: Synthetic oligonucleotide
agucagagagaagaggucagg

SEQ ID NO: 28783 - RNA, 21 nt, Artificial Sequence
  Description of Artificial Sequence: Synthetic oligonucleotide
gagucagagagaagaggucag

SEQ ID NO: 28784 - RNA, 21 nt, Artificial Sequence
  Description of Artificial Sequence: Synthetic oligonucleotide
agagucagagagaagagguca

SEQ ID NO: 28785 - RNA, 21 nt, Artificial Sequence
  Description of Artificial Sequence: Synthetic oligonucleotide
gagagucagagagaagagguc

SEQ ID NO: 28786 - RNA, 21 nt, Artificial Sequence
  Description of Artificial Sequence: Synthetic oligonucleotide
cgagagucagagagaagaggu

SEQ ID NO: 28787 - RNA, 21 nt, Artificial Sequence
  Description of Artificial Sequence: Synthetic oligonucleotide
ucgagagucagagagaagagg

SEQ ID NO: 28788 - RNA, 21 nt, Artificial Sequence
  Description of Artificial Sequence: Synthetic oligonucleotide
gucgagagucagagagaagag

SEQ ID NO: 28789 - RNA, 21 nt, Artificial Sequence
  Description of Artificial Sequence: Synthetic oligonucleotide
agucgagagucagagagaaga

SEQ ID NO: 28790 - RNA, 21 nt, Artificial Sequence
  Description of Artificial Sequence: Synthetic oligonucleotide
aagucgagagucagagagaag

SEQ ID NO: 28791 - RNA, 21 nt, Artificial Sequence
  Description of Artificial Sequence: Synthetic oligonucleotide
caagucgagagucagagagaa

SEQ ID NO: 28792 - RNA, 21 nt, Artificial Sequence
  Description of Artificial Sequence: Synthetic oligonucleotide
acaagucgagagucagagaga

SEQ ID NO: 28793 - RNA, 21 nt, Artificial Sequence
  Description of Artificial Sequence: Synthetic oligonucleotide
cacaagucgagagucagagag

SEQ ID NO: 28794 - RNA, 21 nt, Artificial Sequence
  Description of Artificial Sequence: Synthetic oligonucleotide
acacaagucgagagucagaga

SEQ ID NO: 28795 - RNA, 21 nt, Artificial Sequence
  Description of Artificial Sequence: Synthetic oligonucleotide
aacacaagucgagagucagag

SEQ ID NO: 28796 - RNA, 21 nt, Artificial Sequence
  Description of Artificial Sequence: Synthetic oligonucleotide
gaacacaagucgagagucaga

SEQ ID NO: 28797 - RNA, 21 nt, Artificial Sequence
  Description of Artificial Sequence: Synthetic oligonucleotide
ggaacacaagucgagagucag

SEQ ID NO: 28798 - RNA, 21 nt, Artificial Sequence
  Description of Artificial Sequence: Synthetic oligonucleotide
gggaacacaagucgagaguca

SEQ ID NO: 28799 - RNA, 21 nt, Artificial Sequence
  Description of Artificial Sequence: Synthetic oligonucleotide
ggggaacacaagucgagaguc

SEQ ID NO: 28800 - RNA, 21 nt, Artificial Sequence
  Description of Artificial Sequence: Synthetic oligonucleotide
cggggaacacaagucgagagu

SEQ ID NO: 28801 - RNA, 21 nt, Artificial Sequence
  Description of Artificial Sequence: Synthetic oligonucleotide
gcggggaacacaagucgagag

SEQ ID NO: 28802 - RNA, 21 nt, Artificial Sequence
  Description of Artificial Sequence: Synthetic oligonucleotide
agcggggaacacaagucgaga

SEQ ID NO: 28803 - RNA, 21 nt, Artificial Sequence
  Description of Artificial Sequence: Synthetic oligonucleotide
gagcggggaacacaagucgag

SEQ ID NO: 28804 - RNA, 21 nt, Artificial Sequence
  Description of Artificial Sequence: Synthetic oligonucleotide
ggagcggggaacacaagucga

SEQ ID NO: 28805 - RNA, 21 nt, Artificial Sequence
  Description of Artificial Sequence: Synthetic oligonucleotide
aggagcggggaacacaagucg

SEQ ID NO: 28806 - RNA, 21 nt, Artificial Sequence
  Description of Artificial Sequence: Synthetic oligonucleotide
gaggagcggggaacacaaguc

SEQ ID NO: 28807 - RNA, 21 nt, Artificial Sequence
  Description of Artificial Sequence: Synthetic oligonucleotide
ggaggagcggggaacacaagu

SEQ ID NO: 28808 - RNA, 21 nt, Artificial Sequence
  Description of Artificial Sequence: Synthetic oligonucleotide
gggaggagcggggaacacaag

SEQ ID NO: 28809 - RNA, 21 nt, Artificial Sequence
  Description of Artificial Sequence: Synthetic oligonucleotide
agggaggagcggggaacacaa

SEQ ID NO: 28810 - RNA, 21 nt, Artificial Sequence
  Description of Artificial Sequence: Synthetic oligonucleotide
cagggaggagcggggaacaca

SEQ ID NO: 28811 - RNA, 21 nt, Artificial Sequence
  Description of Artificial Sequence: Synthetic oligonucleotide
ucagggaggagcggggaacac

SEQ ID NO: 28812 - RNA, 21 nt, Artificial Sequence
  Description of Artificial Sequence: Synthetic oligonucleotide
gucagggaggagcggggaaca

SEQ ID NO: 28813 - RNA, 21 nt, Artificial Sequence
  Description of Artificial Sequence: Synthetic oligonucleotide
ggucagggaggagcggggaac

SEQ ID NO: 28814 - RNA, 21 nt, Artificial Sequence
  Description of Artificial Sequence: Synthetic oligonucleotide
aggucagggaggagcggggaa

SEQ ID NO: 28815 - RNA, 21 nt, Artificial Sequence
  Description of Artificial Sequence: Synthetic oligonucleotide
aaggucagggaggagcgggga

SEQ ID NO: 28816 - RNA, 21 nt, Artificial Sequence
  Description of Artificial Sequence: Synthetic oligonucleotide
gaaggucagggaggagcgggg

SEQ ID NO: 28817 - RNA, 21 nt, Artificial Sequence
  Description of Artificial Sequence: Synthetic oligonucleotide
ggaaggucagggaggagcggg

SEQ ID NO: 28818 - RNA, 21 nt, Artificial Sequence
  Description of Artificial Sequence: Synthetic oligonucleotide
aggaaggucagggaggagcgg

SEQ ID NO: 28819 - RNA, 21 nt, Artificial Sequence
  Description of Artificial Sequence: Synthetic oligonucleotide
gaggaaggucagggaggagcg

SEQ ID NO: 28820 - RNA, 21 nt, Artificial Sequence
  Description of Artificial Sequence: Synthetic oligonucleotide
ggaggaaggucagggaggagc

SEQ ID NO: 28821 - RNA, 21 nt, Artificial Sequence
  Description of Artificial Sequence: Synthetic oligonucleotide
gggaggaaggucagggaggag

SEQ ID NO: 28822 - RNA, 21 nt, Artificial Sequence
  Description of Artificial Sequence: Synthetic oligonucleotide
ggggaggaaggucagggagga

SEQ ID NO: 28823 - RNA, 21 nt, Artificial Sequence
  Description of Artificial Sequence: Synthetic oligonucleotide
aggggaggaaggucagggagg

SEQ ID NO: 28824 - RNA, 21 nt, Artificial Sequence
  Description of Artificial Sequence: Synthetic oligonucleotide
gaggggaggaaggucagggag

SEQ ID NO: 28825 - RNA, 21 nt, Artificial Sequence
  Description of Artificial Sequence: Synthetic oligonucleotide
ggaggggaggaaggucaggga

SEQ ID NO: 28826 - RNA, 21 nt, Artificial Sequence
  Description of Artificial Sequence: Synthetic oligonucleotide
gggaggggaggaaggucaggg

SEQ ID NO: 28827 - RNA, 21 nt, Artificial Sequence
  Description of Artificial Sequence: Synthetic oligonucleotide
ggggaggggaggaaggucagg

SEQ ID NO: 28828 - RNA, 21 nt, Artificial Sequence
  Description of Artificial Sequence: Synthetic oligonucleotide
aggggaggggaggaaggucag

SEQ ID NO: 28829 - RNA, 21 nt, Artificial Sequence
  Description of Artificial Sequence: Synthetic oligonucleotide
aaggggaggggaggaagguca

SEQ ID NO: 28830 - RNA, 21 nt, Artificial Sequence
  Description of Artificial Sequence: Synthetic oligonucleotide
aaaggggaggggaggaagguc

SEQ ID NO: 28831 - RNA, 21 nt, Artificial Sequence
  Description of Artificial Sequence: Synthetic oligonucleotide
gaaaggggaggggaggaaggu

SEQ ID NO: 28832 - RNA, 21 nt, Artificial Sequence
  Description of Artificial Sequence: Synthetic oligonucleotide
ugaaaggggaggggaggaagg

SEQ ID NO: 28833 - RNA, 21 nt, Artificial Sequence
  Description of Artificial Sequence: Synthetic oligonucleotide
gugaaaggggaggggaggaag

SEQ ID NO: 28834 - RNA, 21 nt, Artificial Sequence
  Description of Artificial Sequence: Synthetic oligonucleotide
agugaaaggggaggggaggaa

SEQ ID NO: 28835 - RNA, 21 nt, Artificial Sequence
  Description of Artificial Sequence: Synthetic oligonucleotide
gagugaaaggggaggggagga

SEQ ID NO: 28836 - RNA, 21 nt, Artificial Sequence
  Description of Artificial Sequence: Synthetic oligonucleotide
ugagugaaaggggaggggagg

SEQ ID NO: 28837 - RNA, 21 nt, Artificial Sequence
  Description of Artificial Sequence: Synthetic oligonucleotide
uugagugaaaggggaggggag

SEQ ID NO: 28838 - RNA, 21 nt, Artificial Sequence
  Description of Artificial Sequence: Synthetic oligonucleotide
auugagugaaaggggagggga

SEQ ID NO: 28839 - RNA, 21 nt, Artificial Sequence
  Description of Artificial Sequence: Synthetic oligonucleotide
aauugagugaaaggggagggg

SEQ ID NO: 28840 - RNA, 21 nt, Artificial Sequence
  Description of Artificial Sequence: Synthetic oligonucleotide
gaauugagugaaaggggaggg

SEQ ID NO: 28841 - RNA, 21 nt, Artificial Sequence
  Description of Artificial Sequence: Synthetic oligonucleotide
agaauugagugaaaggggagg

SEQ ID NO: 28842 - RNA, 21 nt, Artificial Sequence
  Description of Artificial Sequence: Synthetic oligonucleotide
gagaauugagugaaaggggag

SEQ ID NO: 28843 - RNA, 21 nt, Artificial Sequence
  Description of Artificial Sequence: Synthetic oligonucleotide
ugagaauugagugaaagggga

SEQ ID NO: 28844 - RNA, 21 nt, Artificial Sequence
  Description of Artificial Sequence: Synthetic oligonucleotide
gugagaauugagugaaagggg

SEQ ID NO: 28845 - RNA, 21 nt, Artificial Sequence
  Description of Artificial Sequence: Synthetic oligonucleotide
ggugagaauugagugaaaggg

SEQ ID NO: 28846 - RNA, 21 nt, Artificial Sequence
  Description of Artificial Sequence: Synthetic oligonucleotide
uggugagaauugagugaaagg

SEQ ID NO: 28847 - RNA, 21 nt, Artificial Sequence
  Description of Artificial Sequence: Synthetic oligonucleotide
uuggugagaauugagugaaag

SEQ ID NO: 28848 - RNA, 21 nt, Artificial Sequence
  Description of Artificial Sequence: Synthetic oligonucleotide
guuggugagaauugagugaaa

SEQ ID NO: 28849 - RNA, 21 nt, Artificial Sequence
  Description of Artificial Sequence: Synthetic oligonucleotide
aguuggugagaauugagugaa

SEQ ID NO: 28850 - RNA, 21 nt, Artificial Sequence
  Description of Artificial Sequence: Synthetic oligonucleotide
gaguuggugagaauugaguga

SEQ ID NO: 28851 - RNA, 21 nt, Artificial Sequence
  Description of Artificial Sequence: Synthetic oligonucleotide
agaguuggugagaauugagug

SEQ ID NO: 28852 - RNA, 21 nt, Artificial Sequence
  Description of Artificial Sequence: Synthetic oligonucleotide
aagaguuggugagaauugagu

SEQ ID NO: 28853 - RNA, 21 nt, Artificial Sequence
  Description of Artificial Sequence: Synthetic oligonucleotide
aaagaguuggugagaauugag

SEQ ID NO: 28854 - RNA, 21 nt, Artificial Sequence
  Description of Artificial Sequence: Synthetic oligonucleotide
gaaagaguuggugagaauuga

SEQ ID NO: 28855 - RNA, 21 nt, Artificial Sequence
  Description of Artificial Sequence: Synthetic oligonucleotide
agaaagaguuggugagaauug

SEQ ID NO: 28856 - RNA, 21 nt, Artificial Sequence
  Description of Artificial Sequence: Synthetic oligonucleotide
gagaaagaguuggugagaauu

SEQ ID NO: 28857 - RNA, 21 nt, Artificial Sequence
  Description of Artificial Sequence: Synthetic oligonucleotide
agagaaagaguuggugagaau

SEQ ID NO: 28858 - RNA, 21 nt, Artificial Sequence
  Description of Artificial Sequence: Synthetic oligonucleotide
gagagaaagaguuggugagaa

SEQ ID NO: 28859 - RNA, 21 nt, Artificial Sequence
  Description of Artificial Sequence: Synthetic oligonucleotide
agagagaaagaguuggugaga

SEQ ID NO: 28860 - RNA, 21 nt, Artificial Sequence
  Description of Artificial Sequence: Synthetic oligonucleotide
gagagagaaagaguuggugag

SEQ ID NO: 28861 - RNA, 21 nt, Artificial Sequence
  Description of Artificial Sequence: Synthetic oligonucleotide
agagagagaaagaguugguga

SEQ ID NO: 28862 - RNA, 21 nt, Artificial Sequence
  Description of Artificial Sequence: Synthetic oligonucleotide
cagagagagaaagaguuggug

SEQ ID NO: 28863 - RNA, 21 nt, Artificial Sequence
  Description of Artificial Sequence: Synthetic oligonucleotide
ccagagagagaaagaguuggu

SEQ ID NO: 28864 - RNA, 21 nt, Artificial Sequence
  Description of Artificial Sequence: Synthetic oligonucleotide
accagagagagaaagaguugg

SEQ ID NO: 28865 - RNA, 21 nt, Artificial Sequence
  Description of Artificial Sequence: Synthetic oligonucleotide
caccagagagagaaagaguug

SEQ ID NO: 28866 - RNA, 21 nt, Artificial Sequence
  Description of Artificial Sequence: Synthetic oligonucleotide
acaccagagagagaaagaguu

SEQ ID NO: 28867 - RNA, 21 nt, Artificial Sequence
  Description of Artificial Sequence: Synthetic oligonucleotide
aacaccagagagagaaagagu

SEQ ID NO: 28868 - RNA, 21 nt, Artificial Sequence
  Description of Artificial Sequence: Synthetic oligonucleotide
aaacaccagagagagaaagag

SEQ ID NO: 28869 - RNA, 21 nt, Artificial Sequence
  Description of Artificial Sequence: Synthetic oligonucleotide
aaaacaccagagagagaaaga

SEQ ID NO: 28870 - RNA, 21 nt, Artificial Sequence
  Description of Artificial Sequence: Synthetic oligonucleotide
gaaaacaccagagagagaaag

SEQ ID NO: 28871 - RNA, 21 nt, Artificial Sequence
  Description of Artificial Sequence: Synthetic oligonucleotide
agaaaacaccagagagagaaa

SEQ ID NO: 28872 - RNA, 21 nt, Artificial Sequence
  Description of Artificial Sequence: Synthetic oligonucleotide
gagaaaacaccagagagagaa

SEQ ID NO: 28873 - RNA, 21 nt, Artificial Sequence
  Description of Artificial Sequence: Synthetic oligonucleotide
ggagaaaacaccagagagaga

SEQ ID NO: 28874 - RNA, 21 nt, Artificial Sequence
  Description of Artificial Sequence: Synthetic oligonucleotide
aggagaaaacaccagagagag

SEQ ID NO: 28875 - RNA, 21 nt, Artificial Sequence
  Description of Artificial Sequence: Synthetic oligonucleotide
aaggagaaaacaccagagaga

SEQ ID NO: 28876 - RNA, 21 nt, Artificial Sequence
  Description of Artificial Sequence: Synthetic oligonucleotide
aaaggagaaaacaccagagag

SEQ ID NO: 28877 - RNA, 21 nt, Artificial Sequence
  Description of Artificial Sequence: Synthetic oligonucleotide
aaaaggagaaaacaccagaga

SEQ ID NO: 28878 - RNA, 21 nt, Artificial Sequence
  Description of Artificial Sequence: Synthetic oligonucleotide
gaaaaggagaaaacaccagag

SEQ ID NO: 28879 - RNA, 21 nt, Artificial Sequence
  Description of Artificial Sequence: Synthetic oligonucleotide
agaaaaggagaaaacaccaga

SEQ ID NO: 28880 - RNA, 21 nt, Artificial Sequence
  Description of Artificial Sequence: Synthetic oligonucleotide
gagaaaaggagaaaacaccag

SEQ ID NO: 28881 - RNA, 21 nt, Artificial Sequence
  Description of Artificial Sequence: Synthetic oligonucleotide
cgagaaaaggagaaaacacca

SEQ ID NO: 28882 - RNA, 21 nt, Artificial Sequence
  Description of Artificial Sequence: Synthetic oligonucleotide
acgagaaaaggagaaaacacc

SEQ ID NO: 28883 - RNA, 21 nt, Artificial Sequence
  Description of Artificial Sequence: Synthetic oligonucleotide
uacgagaaaaggagaaaacac

SEQ ID NO: 28884 - RNA, 21 nt, Artificial Sequence
  Description of Artificial Sequence: Synthetic oligonucleotide
uuacgagaaaaggagaaaaca

SEQ ID NO: 28885 - RNA, 21 nt, Artificial Sequence
  Description of Artificial Sequence: Synthetic oligonucleotide
uuuacgagaaaaggagaaaac

SEQ ID NO: 28886 - RNA, 21 nt, Artificial Sequence
  Description of Artificial Sequence: Synthetic oligonucleotide
guuuacgagaaaaggagaaaa

SEQ ID NO: 28887 - RNA, 21 nt, Artificial Sequence
  Description of Artificial Sequence: Synthetic oligonucleotide
aguuuacgagaaaaggagaaa

SEQ ID NO: 28888 - RNA, 21 nt, Artificial Sequence
  Description of Artificial Sequence: Synthetic oligonucleotide
aaguuuacgagaaaaggagaa

SEQ ID NO: 28889 - RNA, 21 nt, Artificial Sequence
  Description of Artificial Sequence: Synthetic oligonucleotide
aaaguuuacgagaaaaggaga

SEQ ID NO: 28890 - RNA, 21 nt, Artificial Sequence
  Description of Artificial Sequence: Synthetic oligonucleotide
caaaguuuacgagaaaaggag

SEQ ID NO: 28891 - RNA, 21 nt, Artificial Sequence
  Description of Artificial Sequence: Synthetic oligonucleotide
gcaaaguuuacgagaaaagga

SEQ ID NO: 28892 - RNA, 21 nt, Artificial Sequence
  Description of Artificial Sequence: Synthetic oligonucleotide
ggcaaaguuuacgagaaaagg

SEQ ID NO: 28893 - RNA, 21 nt, Artificial Sequence
  Description of Artificial Sequence: Synthetic oligonucleotide
cggcaaaguuuacgagaaaag

SEQ ID NO: 28894 - RNA, 21 nt, Artificial Sequence
  Description of Artificial Sequence: Synthetic oligonucleotide
gcggcaaaguuuacgagaaaa

SEQ ID NO: 28895 - RNA, 21 nt, Artificial Sequence
  Description of Artificial Sequence: Synthetic oligonucleotide
ggcggcaaaguuuacgagaaa

SEQ ID NO: 28896 - RNA, 21 nt, Artificial Sequence
  Description of Artificial Sequence: Synthetic oligonucleotide
aggcggcaaaguuuacgagaa

SEQ ID NO: 28897 - RNA, 21 nt, Artificial Sequence
  Description of Artificial Sequence: Synthetic oligonucleotide
uaggcggcaaaguuuacgaga

SEQ ID NO: 28898 - RNA, 21 nt, Artificial Sequence
  Description of Artificial Sequence: Synthetic oligonucleotide
auaggcggcaaaguuuacgag

SEQ ID NO: 28899 - RNA, 21 nt, Artificial Sequence
  Description of Artificial Sequence: Synthetic oligonucleotide
cauaggcggcaaaguuuacga

SEQ ID NO: 28900 - RNA, 21 nt, Artificial Sequence
  Description of Artificial Sequence: Synthetic oligonucleotide
ucauaggcggcaaaguuuacg

SEQ ID NO: 28901 - RNA, 21 nt, Artificial Sequence
  Description of Artificial Sequence: Synthetic oligonucleotide
cucauaggcggcaaaguuuac

SEQ ID NO: 28902 - RNA, 21 nt, Artificial Sequence
  Description of Artificial Sequence: Synthetic oligonucleotide
gcucauaggcggcaaaguuua

SEQ ID NO: 28903 - RNA, 21 nt, Artificial Sequence
  Description of Artificial Sequence: Synthetic oligonucleotide
ugcucauaggcggcaaaguuu

SEQ ID NO: 28904 - RNA, 21 nt, Artificial Sequence
  Description of Artificial Sequence: Synthetic oligonucleotide
cugcucauaggcggcaaaguu

SEQ ID NO: 28905 - RNA, 21 nt, Artificial Sequence
  Description of Artificial Sequence: Synthetic oligonucleotide
gcugcucauaggcggcaaagu

SEQ ID NO: 28906 - RNA, 21 nt, Artificial Sequence
  Description of Artificial Sequence: Synthetic oligonucleotide
ggcugcucauaggcggcaaag

SEQ ID NO: 28907 - RNA, 21 nt, Artificial Sequence
  Description of Artificial Sequence: Synthetic oligonucleotide
uggcugcucauaggcggcaaa

SEQ ID NO: 28908 - RNA, 21 nt, Artificial Sequence
  Description of Artificial Sequence: Synthetic oligonucleotide
guggcugcucauaggcggcaa

SEQ ID NO: 28909 - RNA, 21 nt, Artificial Sequence
  Description of Artificial Sequence: Synthetic oligonucleotide
uguggcugcucauaggcggca

SEQ ID NO: 28910 - RNA, 21 nt, Artificial Sequence
  Description of Artificial Sequence: Synthetic oligonucleotide
auguggcugcucauaggcggc

SEQ ID NO: 28911 - RNA, 21 nt, Artificial Sequence
  Description of Artificial Sequence: Synthetic oligonucleotide
aauguggcugcucauaggcgg

SEQ ID NO: 28912 - RNA, 21 nt, Artificial Sequence
  Description of Artificial Sequence: Synthetic oligonucleotide
caauguggcugcucauaggcg

SEQ ID NO: 28913 - RNA, 21 nt, Artificial Sequence
  Description of Artificial Sequence: Synthetic oligonucleotide
gcaauguggcugcucauaggc

SEQ ID NO: 28914 - RNA, 21 nt, Artificial Sequence
  Description of Artificial Sequence: Synthetic oligonucleotide
ggcaauguggcugcucauagg

SEQ ID NO: 28915 - RNA, 21 nt, Artificial Sequence
  Description of Artificial Sequence: Synthetic oligonucleotide
aggcaauguggcugcucauag

SEQ ID NO: 28916 - RNA, 21 nt, Artificial Sequence
  Description of Artificial Sequence: Synthetic oligonucleotide
aaggcaauguggcugcucaua

SEQ ID NO: 28917 - RNA, 21 nt, Artificial Sequence
  Description of Artificial Sequence: Synthetic oligonucleotide
uaaggcaauguggcugcucau

SEQ ID NO: 28918 - RNA, 21 nt, Artificial Sequence
  Description of Artificial Sequence: Synthetic oligonucleotide
guaaggcaauguggcugcuca

SEQ ID NO: 28919 - RNA, 21 nt, Artificial Sequence
  Description of Artificial Sequence: Synthetic oligonucleotide
aguaaggcaauguggcugcuc

SEQ ID NO: 28920 - RNA, 21 nt, Artificial Sequence
  Description of Artificial Sequence: Synthetic oligonucleotide
caguaaggcaauguggcugcu

SEQ ID NO: 28921 - RNA, 21 nt, Artificial Sequence
  Description of Artificial Sequence: Synthetic oligonucleotide
ucaguaaggcaauguggcugc

SEQ ID NO: 28922 - RNA, 21 nt, Artificial Sequence
  Description of Artificial Sequence: Synthetic oligonucleotide
uaguuggagucucccugauuu

SEQ ID NO: 28923 - RNA, 21 nt, Artificial Sequence
  Description of Artificial Sequence: Synthetic oligonucleotide
uaaguuggagucucccugauu

SEQ ID NO: 28924 - RNA, 21 nt, Artificial Sequence
  Description of Artificial Sequence: Synthetic oligonucleotide
uuaaguuggagucucccuguu

SEQ ID NO: 28925 - RNA, 21 nt, Artificial Sequence
  Description of Artificial Sequence: Synthetic oligonucleotide
uuuaaguuggagucucccuuu

SEQ ID NO: 28926 - RNA, 21 nt, Artificial Sequence
  Description of Artificial Sequence: Synthetic oligonucleotide
ucuuaaguuggagucucccuu

SEQ ID NO: 28927 - RNA, 21 nt, Artificial Sequence
  Description of Artificial Sequence: Synthetic oligonucleotide
uccuuaaguuggagucuccuu

SEQ ID NO: 28928 - RNA, 21 nt, Artificial Sequence
  Description of Artificial Sequence: Synthetic oligonucleotide
ugccuuaaguuggagucucuu

SEQ ID NO: 28929 - RNA, 21 nt, Artificial Sequence
  Description of Artificial Sequence: Synthetic oligonucleotide
uugccuuaaguuggagucuuu

SEQ ID NO: 28930 - RNA, 21 nt, Artificial Sequence
  Description of Artificial Sequence: Synthetic oligonucleotide
uuugccuuaaguuggagucuu

SEQ ID NO: 28931 - RNA, 21 nt, Artificial Sequence
  Description of Artificial Sequence: Synthetic oligonucleotide
uguugccuuaaguuggaguuu

SEQ ID NO: 28932 - RNA, 21 nt, Artificial Sequence
  Description of Artificial Sequence: Synthetic oligonucleotide
uuguugccuuaaguuggaguu

SEQ ID NO: 28933 - RNA, 21 nt, Artificial Sequence
  Description of Artificial Sequence: Synthetic oligonucleotide
ucuguugccuuaaguuggauu

SEQ ID NO: 28934 - RNA, 21 nt, Artificial Sequence
  Description of Artificial Sequence: Synthetic oligonucleotide
ugcuguugccuuaaguugguu

SEQ ID NO: 28935 - RNA, 21 nt, Artificial Sequence
  Description of Artificial Sequence: Synthetic oligonucleotide
uugcuguugccuuaaguuguu

SEQ ID NO: 28936 - RNA, 21 nt, Artificial Sequence
  Description of Artificial Sequence: Synthetic oligonucleotide
uaugcuguugccuuaaguuuu

SEQ ID NO: 28937 - RNA, 21 nt, Artificial Sequence
  Description of Artificial Sequence: Synthetic oligonucleotide
ucaugcuguugccuuaaguuu

SEQ ID NO: 28938 - RNA, 21 nt, Artificial Sequence
  Description of Artificial Sequence: Synthetic oligonucleotide
uccaugcuguugccuuaaguu

SEQ ID NO: 28939 - RNA, 21 nt, Artificial Sequence
  Description of Artificial Sequence: Synthetic oligonucleotide
ucccaugcuguugccuuaauu

SEQ ID NO: 28940 - RNA, 21 nt, Artificial Sequence
  Description of Artificial Sequence: Synthetic oligonucleotide
uacccaugcuguugccuuauu

SEQ ID NO: 28941 - RNA, 21 nt, Artificial Sequence
  Description of Artificial Sequence: Synthetic oligonucleotide
ucacccaugcuguugccuuuu

SEQ ID NO: 28942 - RNA, 21 nt, Artificial Sequence
  Description of Artificial Sequence: Synthetic oligonucleotide
uucacccaugcuguugccuuu

SEQ ID NO: 28943 - RNA, 21 nt, Artificial Sequence
  Description of Artificial Sequence: Synthetic oligonucleotide
uuucacccaugcuguugccuu

SEQ ID NO: 28944 - RNA, 21 nt, Artificial Sequence
  Description of Artificial Sequence: Synthetic oligonucleotide
uauucacccaugcuguugcuu

SEQ ID NO: 28945 - RNA, 21 nt, Artificial Sequence
  Description of Artificial Sequence: Synthetic oligonucleotide
uuauucacccaugcuguuguu

SEQ ID NO: 28946 - RNA, 21 nt, Artificial Sequence
  Description of Artificial Sequence: Synthetic oligonucleotide
uuuauucacccaugcuguuuu

SEQ ID NO: 28947 - RNA, 21 nt, Artificial Sequence
  Description of Artificial Sequence: Synthetic oligonucleotide
ucuuauucacccaugcuguuu

SEQ ID NO: 28948 - RNA, 21 nt, Artificial Sequence
  Description of Artificial Sequence: Synthetic oligonucleotide
uccuuauucacccaugcuguu

SEQ ID NO: 28949 - RNA, 21 nt, Artificial Sequence
  Description of Artificial Sequence: Synthetic oligonucleotide
ucccuuauucacccaugcuuu

SEQ ID NO: 28950 - RNA, 21 nt, Artificial Sequence
  Description of Artificial Sequence: Synthetic oligonucleotide
ugcccuuauucacccaugcuu

SEQ ID NO: 28951 - RNA, 21 nt, Artificial Sequence
  Description of Artificial Sequence: Synthetic oligonucleotide
uagcccuuauucacccauguu

SEQ ID NO: 28952 - RNA, 21 nt, Artificial Sequence
  Description of Artificial Sequence: Synthetic oligonucleotide
uaagcccuuauucacccauuu

SEQ ID NO: 28953 - RNA, 21 nt, Artificial Sequence
  Description of Artificial Sequence: Synthetic oligonucleotide
ugaagcccuuauucacccauu

SEQ ID NO: 28954 - RNA, 21 nt, Artificial Sequence
  Description of Artificial Sequence: Synthetic oligonucleotide
uggaagcccuuauucacccuu

SEQ ID NO: 28955 - RNA, 21 nt, Artificial Sequence
  Description of Artificial Sequence: Synthetic oligonucleotide
uaggaagcccuuauucaccuu

SEQ ID NO: 28956 - RNA, 21 nt, Artificial Sequence
  Description of Artificial Sequence: Synthetic oligonucleotide
ucaggaagcccuuauucacuu

SEQ ID NO: 28957 - RNA, 21 nt, Artificial Sequence
  Description of Artificial Sequence: Synthetic oligonucleotide
uacaggaagcccuuauucauu

SEQ ID NO: 28958 - RNA, 21 nt, Artificial Sequence
  Description of Artificial Sequence: Synthetic oligonucleotide
ucacaggaagcccuuauucuu

SEQ ID NO: 28959 - RNA, 21 nt, Artificial Sequence
  Description of Artificial Sequence: Synthetic oligonucleotide
uccacaggaagcccuuauuuu

SEQ ID NO: 28960 - RNA, 21 nt, Artificial Sequence
  Description of Artificial Sequence: Synthetic oligonucleotide
uuccacaggaagcccuuauuu

SEQ ID NO: 28961 - RNA, 21 nt, Artificial Sequence
  Description of Artificial Sequence: Synthetic oligonucleotide
uguccacaggaagcccuuauu

SEQ ID NO: 28962 - RNA, 21 nt, Artificial Sequence
  Description of Artificial Sequence: Synthetic oligonucleotide
uaguccacaggaagcccuuuu

SEQ ID NO: 28963 - RNA, 21 nt, Artificial Sequence
  Description of Artificial Sequence: Synthetic oligonucleotide
ucaguccacaggaagcccuuu

SEQ ID NO: 28964 - RNA, 21 nt, Artificial Sequence
  Description of Artificial Sequence: Synthetic oligonucleotide
uccaguccacaggaagcccuu

SEQ ID NO: 28965 - RNA, 21 nt, Artificial Sequence
  Description of Artificial Sequence: Synthetic oligonucleotide
ugccaguccacaggaagccuu

SEQ ID NO: 28966 - RNA, 21 nt, Artificial Sequence
  Description of Artificial Sequence: Synthetic oligonucleotide
uugccaguccacaggaagcuu

SEQ ID NO: 28967 - RNA, 21 nt, Artificial Sequence
  Description of Artificial Sequence: Synthetic oligonucleotide
uuugccaguccacaggaaguu

SEQ ID NO: 28968 - RNA, 21 nt, Artificial Sequence
  Description of Artificial Sequence: Synthetic oligonucleotide
uauugccaguccacaggaauu

SEQ ID NO: 28969 - RNA, 21 nt, Artificial Sequence
  Description of Artificial Sequence: Synthetic oligonucleotide
ucauugccaguccacaggauu

SEQ ID NO: 28970 - RNA, 21 nt, Artificial Sequence
  Description of Artificial Sequence: Synthetic oligonucleotide
uucauugccaguccacagguu

SEQ ID NO: 28971 - RNA, 21 nt, Artificial Sequence
  Description of Artificial Sequence: Synthetic oligonucleotide
ucucauugccaguccacaguu

SEQ ID NO: 28972 - RNA, 21 nt, Artificial Sequence
  Description of Artificial Sequence: Synthetic oligonucleotide
uucucauugccaguccacauu

SEQ ID NO: 28973 - RNA, 21 nt, Artificial Sequence
  Description of Artificial Sequence: Synthetic oligonucleotide
ucucucauugccaguccacuu

SEQ ID NO: 28974 - RNA, 21 nt, Artificial Sequence
  Description of Artificial Sequence: Synthetic oligonucleotide
uccucucauugccaguccauu

SEQ ID NO: 28975 - RNA, 21 nt, Artificial Sequence
  Description of Artificial Sequence: Synthetic oligonucleotide
ugccucucauugccaguccuu

SEQ ID NO: 28976 - RNA, 21 nt, Artificial Sequence
  Description of Artificial Sequence: Synthetic oligonucleotide
uugccucucauugccagucuu

SEQ ID NO: 28977 - RNA, 21 nt, Artificial Sequence
  Description of Artificial Sequence: Synthetic oligonucleotide
uuugccucucauugccaguuu

SEQ ID NO: 28978 - RNA, 21 nt, Artificial Sequence
  Description of Artificial Sequence: Synthetic oligonucleotide
uuuugccucucauugccaguu

SEQ ID NO: 28979 - RNA, 21 nt, Artificial Sequence
  Description of Artificial Sequence: Synthetic oligonucleotide
uuuuugccucucauugccauu

SEQ ID NO: 28980 - RNA, 21 nt, Artificial Sequence
  Description of Artificial Sequence: Synthetic oligonucleotide
uguuuugccucucauugccuu

SEQ ID NO: 28981 - RNA, 21 nt, Artificial Sequence
  Description of Artificial Sequence: Synthetic oligonucleotide
ugguuuugccucucauugcuu

SEQ ID NO: 28982 - RNA, 21 nt, Artificial Sequence
  Description of Artificial Sequence: Synthetic oligonucleotide
uagguuuugccucucauuguu

SEQ ID NO: 28983 - RNA, 21 nt, Artificial Sequence
  Description of Artificial Sequence: Synthetic oligonucleotide
ucagguuuugccucucauuuu

SEQ ID NO: 28984 - RNA, 21 nt, Artificial Sequence
  Description of Artificial Sequence: Synthetic oligonucleotide
uccagguuuugccucucauuu

SEQ ID NO: 28985 - RNA, 21 nt, Artificial Sequence
  Description of Artificial Sequence: Synthetic oligonucleotide
uaccagguuuugccucucauu

SEQ ID NO: 28986 - RNA, 21 nt, Artificial Sequence
  Description of Artificial Sequence: Synthetic oligonucleotide
ucaccagguuuugccucucuu

SEQ ID NO: 28987 - RNA, 21 nt, Artificial Sequence
  Description of Artificial Sequence: Synthetic oligonucleotide
ugcaccagguuuugccucuuu

SEQ ID NO: 28988 - RNA, 21 nt, Artificial Sequence
  Description of Artificial Sequence: Synthetic oligonucleotide
uagcaccagguuuugccucuu

SEQ ID NO: 28989 - RNA, 21 nt, Artificial Sequence
  Description of Artificial Sequence: Synthetic oligonucleotide
uaagcaccagguuuugccuuu

SEQ ID NO: 28990 - RNA, 21 nt, Artificial Sequence
  Description of Artificial Sequence: Synthetic oligonucleotide
ucaagcaccagguuuugccuu

SEQ ID NO: 28991 - RNA, 21 nt, Artificial Sequence
  Description of Artificial Sequence: Synthetic oligonucleotide
uucaagcaccagguuuugcuu

SEQ ID NO: 28992 - RNA, 21 nt, Artificial Sequence
  Description of Artificial Sequence: Synthetic oligonucleotide
ucucaagcaccagguuuuguu

SEQ ID NO: 28993 - RNA, 21 nt, Artificial Sequence
  Description of Artificial Sequence: Synthetic oligonucleotide
ugcucaagcaccagguuuuuu

SEQ ID NO: 28994 - RNA, 21 nt, Artificial Sequence
  Description of Artificial Sequence: Synthetic oligonucleotide
uugcucaagcaccagguuuuu

SEQ ID NO: 28995 - RNA, 21 nt, Artificial Sequence
  Description of Artificial Sequence: Synthetic oligonucleotide
ugugcucaagcaccagguuuu

SEQ ID NO: 28996 - RNA, 21 nt, Artificial Sequence
  Description of Artificial Sequence: Synthetic oligonucleotide
uagugcucaagcaccagguuu

SEQ ID NO: 28997 - RNA, 21 nt, Artificial Sequence
  Description of Artificial Sequence: Synthetic oligonucleotide
ucagugcucaagcaccagguu

SEQ ID NO: 28998 - RNA, 21 nt, Artificial Sequence
  Description of Artificial Sequence: Synthetic oligonucleotide
uccagugcucaagcaccaguu

SEQ ID NO: 28999 - RNA, 21 nt, Artificial Sequence
  Description of Artificial Sequence: Synthetic oligonucleotide
ugccagugcucaagcaccauu

SEQ ID NO: 29000 - RNA, 21 nt, Artificial Sequence
  Description of Artificial Sequence: Synthetic oligonucleotide
uggccagugcucaagcaccuu

SEQ ID NO: 29001 - RNA, 21 nt, Artificial Sequence
  Description of Artificial Sequence: Synthetic oligonucleotide
ugggccagugcucaagcacuu

SEQ ID NO: 29002 - RNA, 21 nt, Artificial Sequence
  Description of Artificial Sequence: Synthetic oligonucleotide
uggggccagugcucaagcauu

SEQ ID NO: 29003 - RNA, 21 nt, Artificial Sequence
  Description of Artificial Sequence: Synthetic oligonucleotide
uaggggccagugcucaagcuu

SEQ ID NO: 29004 - RNA, 21 nt, Artificial Sequence
  Description of Artificial Sequence: Synthetic oligonucleotide
uuaggggccagugcucaaguu

SEQ ID NO: 29005 - RNA, 21 nt, Artificial Sequence
  Description of Artificial Sequence: Synthetic oligonucleotide
uuuaggggccagugcucaauu

SEQ ID NO: 29006 - RNA, 21 nt, Artificial Sequence
  Description of Artificial Sequence: Synthetic oligonucleotide
ucuuaggggccagugcucauu

SEQ ID NO: 29007 - RNA, 21 nt, Artificial Sequence
  Description of Artificial Sequence: Synthetic oligonucleotide
uccuuaggggccagugcucuu

SEQ ID NO: 29008 - RNA, 21 nt, Artificial Sequence
  Description of Artificial Sequence: Synthetic oligonucleotide
ugccuuaggggccagugcuuu

SEQ ID NO: 29009 - RNA, 21 nt, Artificial Sequence
  Description of Artificial Sequence: Synthetic oligonucleotide
uugccuuaggggccagugcuu

SEQ ID NO: 29010 - RNA, 21 nt, Artificial Sequence
  Description of Artificial Sequence: Synthetic oligonucleotide
ucugccuuaggggccaguguu

SEQ ID NO: 29011 - RNA, 21 nt, Artificial Sequence
  Description of Artificial Sequence: Synthetic oligonucleotide
uccugccuuaggggccaguuu

SEQ ID NO: 29012 - RNA, 21 nt, Artificial Sequence
  Description of Artificial Sequence: Synthetic oligonucleotide
ugccugccuuaggggccaguu

SEQ ID NO: 29013 - RNA, 21 nt, Artificial Sequence
  Description of Artificial Sequence: Synthetic oligonucleotide
uggccugccuuaggggccauu

SEQ ID NO: 29014 - RNA, 21 nt, Artificial Sequence
  Description of Artificial Sequence: Synthetic oligonucleotide
uaggccugccuuaggggccuu

SEQ ID NO: 29015 - RNA, 21 nt, Artificial Sequence
  Description of Artificial Sequence: Synthetic oligonucleotide
uaaggccugccuuaggggcuu

SEQ ID NO: 29016 - RNA, 21 nt, Artificial Sequence
  Description of Artificial Sequence: Synthetic oligonucleotide
uuaaggccugccuuagggguu

SEQ ID NO: 29017 - RNA, 21 nt, Artificial Sequence
  Description of Artificial Sequence: Synthetic oligonucleotide
uguaaggccugccuuaggguu

SEQ ID NO: 29018 - RNA, 21 nt, Artificial Sequence
  Description of Artificial Sequence: Synthetic oligonucleotide
uuguaaggccugccuuagguu

SEQ ID NO: 29019 - RNA, 21 nt, Artificial Sequence
  Description of Artificial Sequence: Synthetic oligonucleotide
ucuguaaggccugccuuaguu

SEQ ID NO: 29020 - RNA, 21 nt, Artificial Sequence
  Description of Artificial Sequence: Synthetic oligonucleotide
uucuguaaggccugccuuauu

SEQ ID NO: 29021 - RNA, 21 nt, Artificial Sequence
  Description of Artificial Sequence: Synthetic oligonucleotide
uaucuguaaggccugccuuuu

SEQ ID NO: 29022 - RNA, 21 nt, Artificial Sequence
  Description of Artificial Sequence: Synthetic oligonucleotide
ugaucuguaaggccugccuuu

SEQ ID NO: 29023 - RNA, 21 nt, Artificial Sequence
  Description of Artificial Sequence: Synthetic oligonucleotide
uagaucuguaaggccugccuu

SEQ ID NO: 29024 - RNA, 21 nt, Artificial Sequence
  Description of Artificial Sequence: Synthetic oligonucleotide
ugagaucuguaaggccugcuu

SEQ ID NO: 29025 - RNA, 21 nt, Artificial Sequence
  Description of Artificial Sequence: Synthetic oligonucleotide
uagagaucuguaaggccuguu

SEQ ID NO: 29026 - RNA, 21 nt, Artificial Sequence
  Description of Artificial Sequence: Synthetic oligonucleotide
uaagagaucuguaaggccuuu

SEQ ID NO: 29027 - RNA, 21 nt, Artificial Sequence
  Description of Artificial Sequence: Synthetic oligonucleotide
uuaagagaucuguaaggccuu

SEQ ID NO: 29028 - RNA, 21 nt, Artificial Sequence
  Description of Artificial Sequence: Synthetic oligonucleotide
uguaagagaucuguaaggcuu

SEQ ID NO: 29029 - RNA, 21 nt, Artificial Sequence
  Description of Artificial Sequence: Synthetic oligonucleotide
uuguaagagaucuguaagguu

SEQ ID NO: 29030 - RNA, 21 nt, Artificial Sequence
  Description of Artificial Sequence: Synthetic oligonucleotide
uguguaagagaucuguaaguu

SEQ ID NO: 29031 - RNA, 21 nt, Artificial Sequence
  Description of Artificial Sequence: Synthetic oligonucleotide
uaguguaagagaucuguaauu

SEQ ID NO: 29032 - RNA, 21 nt, Artificial Sequence
  Description of Artificial Sequence: Synthetic oligonucleotide
ugaguguaagagaucuguauu

SEQ ID NO: 29033 - RNA, 21 nt, Artificial Sequence
  Description of Artificial Sequence: Synthetic oligonucleotide
ucgaguguaagagaucuguuu

SEQ ID NO: 29034 - RNA, 21 nt, Artificial Sequence
  Description of Artificial Sequence: Synthetic oligonucleotide
uacgaguguaagagaucuguu

SEQ ID NO: 29035 - RNA, 21 nt, Artificial Sequence
  Description of Artificial Sequence: Synthetic oligonucleotide
ucacgaguguaagagaucuuu

SEQ ID NO: 29036 - RNA, 21 nt, Artificial Sequence
  Description of Artificial Sequence: Synthetic oligonucleotide
uccacgaguguaagagaucuu

SEQ ID NO: 29037 - RNA, 21 nt, Artificial Sequence
  Description of Artificial Sequence: Synthetic oligonucleotide
uaccacgaguguaagagauuu

SEQ ID NO: 29038 - RNA, 21 nt, Artificial Sequence
  Description of Artificial Sequence: Synthetic oligonucleotide
ucaccacgaguguaagagauu

SEQ ID NO: 29039 - RNA, 21 nt, Artificial Sequence
  Description of Artificial Sequence: Synthetic oligonucleotide
uccaccacgaguguaagaguu

SEQ ID NO: 29040 - RNA, 21 nt, Artificial Sequence
  Description of Artificial Sequence: Synthetic oligonucleotide
ucccaccacgaguguaagauu

SEQ ID NO: 29041 - RNA, 21 nt, Artificial Sequence
  Description of Artificial Sequence: Synthetic oligonucleotide
uucccaccacgaguguaaguu

SEQ ID NO: 29042 - RNA, 21 nt, Artificial Sequence
  Description of Artificial Sequence: Synthetic oligonucleotide
uuucccaccacgaguguaauu

SEQ ID NO: 29043 - RNA, 21 nt, Artificial Sequence
  Description of Artificial Sequence: Synthetic oligonucleotide
ucuucccaccacgaguguauu

SEQ ID NO: 29044 - RNA, 21 nt, Artificial Sequence
  Description of Artificial Sequence: Synthetic oligonucleotide
uucuucccaccacgaguguuu

SEQ ID NO: 29045 - RNA, 21 nt, Artificial Sequence
  Description of Artificial Sequence: Synthetic oligonucleotide
ucucuucccaccacgaguguu

SEQ ID NO: 29046 - RNA, 21 nt, Artificial Sequence
  Description of Artificial Sequence: Synthetic oligonucleotide
uacucuucccaccacgaguuu

SEQ ID NO: 29047 - RNA, 21 nt, Artificial Sequence
  Description of Artificial Sequence: Synthetic oligonucleotide
uaacucuucccaccacgaguu

SEQ ID NO: 29048 - RNA, 21 nt, Artificial Sequence
  Description of Artificial Sequence: Synthetic oligonucleotide
uaaacucuucccaccacgauu

SEQ ID NO: 29049 - RNA, 21 nt, Artificial Sequence
  Description of Artificial Sequence: Synthetic oligonucleotide
uuaaacucuucccaccacguu

SEQ ID NO: 29050 - RNA, 21 nt, Artificial Sequence
  Description of Artificial Sequence: Synthetic oligonucleotide
ucuaaacucuucccaccacuu

SEQ ID NO: 29051 - RNA, 21 nt, Artificial Sequence
  Description of Artificial Sequence: Synthetic oligonucleotide
uacuaaacucuucccaccauu

SEQ ID NO: 29052 - RNA, 21 nt, Artificial Sequence
  Description of Artificial Sequence: Synthetic oligonucleotide
ucacuaaacucuucccaccuu

SEQ ID NO: 29053 - RNA, 21 nt, Artificial Sequence
  Description of Artificial Sequence: Synthetic oligonucleotide
uacacuaaacucuucccacuu

SEQ ID NO: 29054 - RNA, 21 nt, Artificial Sequence
  Description of Artificial Sequence: Synthetic oligonucleotide
ucacacuaaacucuucccauu

SEQ ID NO: 29055 - RNA, 21 nt, Artificial Sequence
  Description of Artificial Sequence: Synthetic oligonucleotide
uucacacuaaacucuucccuu

SEQ ID NO: 29056 - RNA, 21 nt, Artificial Sequence
  Description of Artificial Sequence: Synthetic oligonucleotide
uuucacacuaaacucuuccuu

SEQ ID NO: 29057 - RNA, 21 nt, Artificial Sequence
  Description of Artificial Sequence: Synthetic oligonucleotide
uuuucacacuaaacucuucuu

SEQ ID NO: 29058 - RNA, 21 nt, Artificial Sequence
  Description of Artificial Sequence: Synthetic oligonucleotide
uguuucacacuaaacucuuuu

SEQ ID NO: 29059 - RNA, 21 nt, Artificial Sequence
  Description of Artificial Sequence: Synthetic oligonucleotide
uaguuucacacuaaacucuuu

SEQ ID NO: 29060 - RNA, 21 nt, Artificial Sequence
  Description of Artificial Sequence: Synthetic oligonucleotide
ucaguuucacacuaaacucuu

SEQ ID NO: 29061 - RNA, 21 nt, Artificial Sequence
  Description of Artificial Sequence: Synthetic oligonucleotide
uccaguuucacacuaaacuuu

SEQ ID NO: 29062 - RNA, 21 nt, Artificial Sequence
  Description of Artificial Sequence: Synthetic oligonucleotide
ucccaguuucacacuaaacuu

SEQ ID NO: 29063 - RNA, 21 nt, Artificial Sequence
  Description of Artificial Sequence: Synthetic oligonucleotide
uccccaguuucacacuaaauu

SEQ ID NO: 29064 - RNA, 21 nt, Artificial Sequence
  Description of Artificial Sequence: Synthetic oligonucleotide
uaccccaguuucacacuaauu

SEQ ID NO: 29065 - RNA, 21 nt, Artificial Sequence
  Description of Artificial Sequence: Synthetic oligonucleotide
ucaccccaguuucacacuauu

SEQ ID NO: 29066 - RNA, 21 nt, Artificial Sequence
  Description of Artificial Sequence: Synthetic oligonucleotide
uccaccccaguuucacacuuu

SEQ ID NO: 29067 - RNA, 21 nt, Artificial Sequence
  Description of Artificial Sequence: Synthetic oligonucleotide
uuccaccccaguuucacacuu

SEQ ID NO: 29068 - RNA, 21 nt, Artificial Sequence
  Description of Artificial Sequence: Synthetic oligonucleotide
uuuccaccccaguuucacauu

SEQ ID NO: 29069 - RNA, 21 nt, Artificial Sequence
  Description of Artificial Sequence: Synthetic oligonucleotide
uauuccaccccaguuucacuu

SEQ ID NO: 29070 - RNA, 21 nt, Artificial Sequence
  Description of Artificial Sequence: Synthetic oligonucleotide
uaauuccaccccaguuucauu

SEQ ID NO: 29071 - RNA, 21 nt, Artificial Sequence
  Description of Artificial Sequence: Synthetic oligonucleotide
ucaauuccaccccaguuucuu

SEQ ID NO: 29072 - RNA, 21 nt, Artificial Sequence
  Description of Artificial Sequence: Synthetic oligonucleotide
uccaauuccaccccaguuuuu

SEQ ID NO: 29073 - RNA, 21 nt, Artificial Sequence
  Description of Artificial Sequence: Synthetic oligonucleotide
ucccaauuccaccccaguuuu

SEQ ID NO: 29074 - RNA, 21 nt, Artificial Sequence
  Description of Artificial Sequence: Synthetic oligonucleotide
uacccaauuccaccccaguuu

SEQ ID NO: 29075 - RNA, 21 nt, Artificial Sequence
  Description of Artificial Sequence: Synthetic oligonucleotide
ucacccaauuccaccccaguu

SEQ ID NO: 29076 - RNA, 21 nt, Artificial Sequence
  Description of Artificial Sequence: Synthetic oligonucleotide
uacacccaauuccaccccauu

SEQ ID NO: 29077 - RNA, 21 nt, Artificial Sequence
  Description of Artificial Sequence: Synthetic oligonucleotide
ugacacccaauuccaccccuu

SEQ ID NO: 29078 - RNA, 21 nt, Artificial Sequence
  Description of Artificial Sequence: Synthetic oligonucleotide
uggacacccaauuccacccuu

SEQ ID NO: 29079 - RNA, 21 nt, Artificial Sequence
  Description of Artificial Sequence: Synthetic oligonucleotide
uuggacacccaauuccaccuu

SEQ ID NO: 29080 - RNA, 21 nt, Artificial Sequence
  Description of Artificial Sequence: Synthetic oligonucleotide
uguggacacccaauuccacuu

SEQ ID NO: 29081 - RNA, 21 nt, Artificial Sequence
  Description of Artificial Sequence: Synthetic oligonucleotide
ucguggacacccaauuccauu

SEQ ID NO: 29082 - RNA, 21 nt, Artificial Sequence
  Description of Artificial Sequence: Synthetic oligonucleotide
uacguggacacccaauuccuu

SEQ ID NO: 29083 - RNA, 21 nt, Artificial Sequence
  Description of Artificial Sequence: Synthetic oligonucleotide
uuacguggacacccaauucuu

SEQ ID NO: 29084 - RNA, 21 nt, Artificial Sequence
  Description of Artificial Sequence: Synthetic oligonucleotide
uauacguggacacccaauuuu

SEQ ID NO: 29085 - RNA, 21 nt, Artificial Sequence
  Description of Artificial Sequence: Synthetic oligonucleotide
ucauacguggacacccaauuu

SEQ ID NO: 29086 - RNA, 21 nt, Artificial Sequence
  Description of Artificial Sequence: Synthetic oligonucleotide
uacauacguggacacccaauu

SEQ ID NO: 29087 - RNA, 21 nt, Artificial Sequence
  Description of Artificial Sequence: Synthetic oligonucleotide
uaacauacguggacacccauu

SEQ ID NO: 29088 - RNA, 21 nt, Artificial Sequence
  Description of Artificial Sequence: Synthetic oligonucleotide
ugaacauacguggacacccuu

SEQ ID NO: 29089 - RNA, 21 nt, Artificial Sequence
  Description of Artificial Sequence: Synthetic oligonucleotide
uggaacauacguggacaccuu

SEQ ID NO: 29090 - RNA, 21 nt, Artificial Sequence
  Description of Artificial Sequence: Synthetic oligonucleotide
ugggaacauacguggacacuu

SEQ ID NO: 29091 - RNA, 21 nt, Artificial Sequence
  Description of Artificial Sequence: Synthetic oligonucleotide
uagggaacauacguggacauu

SEQ ID NO: 29092 - RNA, 21 nt, Artificial Sequence
  Description of Artificial Sequence: Synthetic oligonucleotide
uaagggaacauacguggacuu

SEQ ID NO: 29093 - RNA, 21 nt, Artificial Sequence
  Description of Artificial Sequence: Synthetic oligonucleotide
uaaagggaacauacguggauu

SEQ ID NO: 29094 - RNA, 21 nt, Artificial Sequence
  Description of Artificial Sequence: Synthetic oligonucleotide
uaaaagggaacauacgugguu

SEQ ID NO: 29095 - RNA, 21 nt, Artificial Sequence
  Description of Artificial Sequence: Synthetic oligonucleotide
ucaaaagggaacauacguguu

SEQ ID NO: 29096 - RNA, 21 nt, Artificial Sequence
  Description of Artificial Sequence: Synthetic oligonucleotide
ugcaaaagggaacauacguuu

SEQ ID NO: 29097 - RNA, 21 nt, Artificial Sequence
  Description of Artificial Sequence: Synthetic oligonucleotide
uggcaaaagggaacauacguu

SEQ ID NO: 29098 - RNA, 21 nt, Artificial Sequence
  Description of Artificial Sequence: Synthetic oligonucleotide
uaggcaaaagggaacauacuu

SEQ ID NO: 29099 - RNA, 21 nt, Artificial Sequence
  Description of Artificial Sequence: Synthetic oligonucleotide
uaaggcaaaagggaacauauu

SEQ ID NO: 29100 - RNA, 21 nt, Artificial Sequence
  Description of Artificial Sequence: Synthetic oligonucleotide
uuaaggcaaaagggaacauuu

SEQ ID NO: 29101 - RNA, 21 nt, Artificial Sequence
  Description of Artificial Sequence: Synthetic oligonucleotide
uguaaggcaaaagggaacauu

SEQ ID NO: 29102 - RNA, 21 nt, Artificial Sequence
  Description of Artificial Sequence: Synthetic oligonucleotide
uaguaaggcaaaagggaacuu

SEQ ID NO: 29103 - RNA, 21 nt, Artificial Sequence
  Description of Artificial Sequence: Synthetic oligonucleotide
uuaguaaggcaaaagggaauu

SEQ ID NO: 29104 - RNA, 21 nt, Artificial Sequence
  Description of Artificial Sequence: Synthetic oligonucleotide
uauaguaaggcaaaagggauu

SEQ ID NO: 29105 - RNA, 21 nt, Artificial Sequence
  Description of Artificial Sequence: Synthetic oligonucleotide
uuauaguaaggcaaaaggguu

SEQ ID NO: 29106 - RNA, 21 nt, Artificial Sequence
  Description of Artificial Sequence: Synthetic oligonucleotide
uauauaguaaggcaaaagguu

SEQ ID NO: 29107 - RNA, 21 nt, Artificial Sequence
  Description of Artificial Sequence: Synthetic oligonucleotide
ucauauaguaaggcaaaaguu

SEQ ID NO: 29108 - RNA, 21 nt, Artificial Sequence
  Description of Artificial Sequence: Synthetic oligonucleotide
uacauauaguaaggcaaaauu

SEQ ID NO: 29109 - RNA, 21 nt, Artificial Sequence
  Description of Artificial Sequence: Synthetic oligonucleotide
uaacauauaguaaggcaaauu

SEQ ID NO: 29110 - RNA, 21 nt, Artificial Sequence
  Description of Artificial Sequence: Synthetic oligonucleotide
ugaacauauaguaaggcaauu

SEQ ID NO: 29111 - RNA, 21 nt, Artificial Sequence
  Description of Artificial Sequence: Synthetic oligonucleotide
uagaacauauaguaaggcauu

SEQ ID NO: 29112 - RNA, 21 nt, Artificial Sequence
  Description of Artificial Sequence: Synthetic oligonucleotide
ucagaacauauaguaaggcuu

SEQ ID NO: 29113 - RNA, 21 nt, Artificial Sequence
  Description of Artificial Sequence: Synthetic oligonucleotide
uacagaacauauaguaagguu

SEQ ID NO: 29114 - RNA, 21 nt, Artificial Sequence
  Description of Artificial Sequence: Synthetic oligonucleotide
ugacagaacauauaguaaguu

SEQ ID NO: 29115 - RNA, 21 nt, Artificial Sequence
  Description of Artificial Sequence: Synthetic oligonucleotide
uugacagaacauauaguaauu

SEQ ID NO: 29116 - RNA, 21 nt, Artificial Sequence
  Description of Artificial Sequence: Synthetic oligonucleotide
ucugacagaacauauaguauu

SEQ ID NO: 29117 - RNA, 21 nt, Artificial Sequence
  Description of Artificial Sequence: Synthetic oligonucleotide
uacugacagaacauauaguuu

SEQ ID NO: 29118 - RNA, 21 nt, Artificial Sequence
  Description of Artificial Sequence: Synthetic oligonucleotide
uaacugacagaacauauaguu

SEQ ID NO: 29119 - RNA, 21 nt, Artificial Sequence
  Description of Artificial Sequence: Synthetic oligonucleotide
uaaacugacagaacauauauu

SEQ ID NO: 29120 - RNA, 21 nt, Artificial Sequence
  Description of Artificial Sequence: Synthetic oligonucleotide
ugaaacugacagaacauauuu

SEQ ID NO: 29121 - RNA, 21 nt, Artificial Sequence
  Description of Artificial Sequence: Synthetic oligonucleotide
uagaaacugacagaacauauu

SEQ ID NO: 29122 - RNA, 21 nt, Artificial Sequence
  Description of Artificial Sequence: Synthetic oligonucleotide
uaagaaacugacagaacauuu

SEQ ID NO: 29123 - RNA, 21 nt, Artificial Sequence
  Description of Artificial Sequence: Synthetic oligonucleotide
uaaagaaacugacagaacauu

SEQ ID NO: 29124 - RNA, 21 nt, Artificial Sequence
  Description of Artificial Sequence: Synthetic oligonucleotide
ugaaagaaacugacagaacuu

SEQ ID NO: 29125 - RNA, 21 nt, Artificial Sequence
  Description of Artificial Sequence: Synthetic oligonucleotide
uugaaagaaacugacagaauu

SEQ ID NO: 29126 - RNA, 21 nt, Artificial Sequence
  Description of Artificial Sequence: Synthetic oligonucleotide
ucugaaagaaacugacagauu

SEQ ID NO: 29127 - RNA, 21 nt, Artificial Sequence
  Description of Artificial Sequence: Synthetic oligonucleotide
uccugaaagaaacugacaguu

SEQ ID NO: 29128 - RNA, 21 nt, Artificial Sequence
  Description of Artificial Sequence: Synthetic oligonucleotide
uuccugaaagaaacugacauu

SEQ ID NO: 29129 - RNA, 21 nt, Artificial Sequence
  Description of Artificial Sequence: Synthetic oligonucleotide
uuuccugaaagaaacugacuu

SEQ ID NO: 29130 - RNA, 21 nt, Artificial Sequence
  Description of Artificial Sequence: Synthetic oligonucleotide
uuuuccugaaagaaacugauu

SEQ ID NO: 29131 - RNA, 21 nt, Artificial Sequence
  Description of Artificial Sequence: Synthetic oligonucleotide
uuuuuccugaaagaaacuguu

SEQ ID NO: 29132 - RNA, 21 nt, Artificial Sequence
  Description of Artificial Sequence: Synthetic oligonucleotide
uauuuuccugaaagaaacuuu

SEQ ID NO: 29133 - RNA, 21 nt, Artificial Sequence
  Description of Artificial Sequence: Synthetic oligonucleotide
ugauuuuccugaaagaaacuu

SEQ ID NO: 29134 - RNA, 21 nt, Artificial Sequence
  Description of Artificial Sequence: Synthetic oligonucleotide
uagauuuuccugaaagaaauu

SEQ ID NO: 29135 - RNA, 21 nt, Artificial Sequence
  Description of Artificial Sequence: Synthetic oligonucleotide
uaagauuuuccugaaagaauu

SEQ ID NO: 29136 - RNA, 21 nt, Artificial Sequence
  Description of Artificial Sequence: Synthetic oligonucleotide
ugaagauuuuccugaaagauu

SEQ ID NO: 29137 - RNA, 21 nt, Artificial Sequence
  Description of Artificial Sequence: Synthetic oligonucleotide
uugaagauuuuccugaaaguu

SEQ ID NO: 29138 - RNA, 21 nt, Artificial Sequence
  Description of Artificial Sequence: Synthetic oligonucleotide
uaugaagauuuuccugaaauu

SEQ ID NO: 29139 - RNA, 21 nt, Artificial Sequence
  Description of Artificial Sequence: Synthetic oligonucleotide
ugaugaagauuuuccugaauu

SEQ ID NO: 29140 - RNA, 21 nt, Artificial Sequence
  Description of Artificial Sequence: Synthetic oligonucleotide
uagaugaagauuuuccugauu

SEQ ID NO: 29141 - RNA, 21 nt, Artificial Sequence
  Description of Artificial Sequence: Synthetic oligonucleotide
uaagaugaagauuuuccuguu

SEQ ID NO: 29142 - RNA, 21 nt, Artificial Sequence
  Description of Artificial Sequence: Synthetic oligonucleotide
uuaagaugaagauuuuccuuu

SEQ ID NO: 29143 - RNA, 21 nt, Artificial Sequence
  Description of Artificial Sequence: Synthetic oligonucleotide
uguaagaugaagauuuuccuu

SEQ ID NO: 29144 - RNA, 21 nt, Artificial Sequence
  Description of Artificial Sequence: Synthetic oligonucleotide
uuguaagaugaagauuuucuu

SEQ ID NO: 29145 - RNA, 21 nt, Artificial Sequence
  Description of Artificial Sequence: Synthetic oligonucleotide
uuuguaagaugaagauuuuuu

SEQ ID NO: 29146 - RNA, 21 nt, Artificial Sequence
  Description of Artificial Sequence: Synthetic oligonucleotide
uguuguaagaugaagauuuuu

SEQ ID NO: 29147 - RNA, 21 nt, Artificial Sequence
  Description of Artificial Sequence: Synthetic oligonucleotide
uaguuguaagaugaagauuuu

SEQ ID NO: 29148 - RNA, 21 nt, Artificial Sequence
  Description of Artificial Sequence: Synthetic oligonucleotide
uaaguuguaagaugaagauuu

SEQ ID NO: 29149 - RNA, 21 nt, Artificial Sequence
  Description of Artificial Sequence: Synthetic oligonucleotide
ucaaguuguaagaugaagauu

SEQ ID NO: 29150 - RNA, 21 nt, Artificial Sequence
  Description of Artificial Sequence: Synthetic oligonucleotide
uacaaguuguaagaugaaguu

SEQ ID NO: 29151 - RNA, 21 nt, Artificial Sequence
  Description of Artificial Sequence: Synthetic oligonucleotide
uuacaaguuguaagaugaauu

SEQ ID NO: 29152 - RNA, 21 nt, Artificial Sequence
  Description of Artificial Sequence: Synthetic oligonucleotide
ucuacaaguuguaagaugauu

SEQ ID NO: 29153 - RNA, 21 nt, Artificial Sequence
  Description of Artificial Sequence: Synthetic oligonucleotide
uccuacaaguuguaagauguu

SEQ ID NO: 29154 - RNA, 21 nt, Artificial Sequence
  Description of Artificial Sequence: Synthetic oligonucleotide
ucccuacaaguuguaagauuu

SEQ ID NO: 29155 - RNA, 21 nt, Artificial Sequence
  Description of Artificial Sequence: Synthetic oligonucleotide
ugcccuacaaguuguaagauu

SEQ ID NO: 29156 - RNA, 21 nt, Artificial Sequence
  Description of Artificial Sequence: Synthetic oligonucleotide
uagcccuacaaguuguaaguu

SEQ ID NO: 29157 - RNA, 21 nt, Artificial Sequence
  Description of Artificial Sequence: Synthetic oligonucleotide
ucagcccuacaaguuguaauu

SEQ ID NO: 29158 - RNA, 21 nt, Artificial Sequence
  Description of Artificial Sequence: Synthetic oligonucleotide
uccagcccuacaaguuguauu

SEQ ID NO: 29159 - RNA, 21 nt, Artificial Sequence
  Description of Artificial Sequence: Synthetic oligonucleotide
uaccagcccuacaaguuguuu

SEQ ID NO: 29160 - RNA, 21 nt, Artificial Sequence
  Description of Artificial Sequence: Synthetic oligonucleotide
ucaccagcccuacaaguuguu

SEQ ID NO: 29161 - RNA, 21 nt, Artificial Sequence
  Description of Artificial Sequence: Synthetic oligonucleotide
uacaccagcccuacaaguuuu

SEQ ID NO: 29162 - RNA, 21 nt, Artificial Sequence
  Description of Artificial Sequence: Synthetic oligonucleotide
uaacaccagcccuacaaguuu

SEQ ID NO: 29163 - RNA, 21 nt, Artificial Sequence
  Description of Artificial Sequence: Synthetic oligonucleotide
uuaacaccagcccuacaaguu

SEQ ID NO: 29164 - RNA, 21 nt, Artificial Sequence
  Description of Artificial Sequence: Synthetic oligonucleotide
uuuaacaccagcccuacaauu

SEQ ID NO: 29165 - RNA, 21 nt, Artificial Sequence
  Description of Artificial Sequence: Synthetic oligonucleotide
uguuaacaccagcccuacauu

SEQ ID NO: 29166 - RNA, 21 nt, Artificial Sequence
  Description of Artificial Sequence: Synthetic oligonucleotide
uaguuaacaccagcccuacuu

SEQ ID NO: 29167 - RNA, 21 nt, Artificial Sequence
  Description of Artificial Sequence: Synthetic oligonucleotide
uaaguuaacaccagcccuauu

SEQ ID NO: 29168 - RNA, 21 nt, Artificial Sequence
  Description of Artificial Sequence: Synthetic oligonucleotide
uuaaguuaacaccagcccuuu

SEQ ID NO: 29169 - RNA, 21 nt, Artificial Sequence
  Description of Artificial Sequence: Synthetic oligonucleotide
uguaaguuaacaccagcccuu

SEQ ID NO: 29170 - RNA, 21 nt, Artificial Sequence
  Description of Artificial Sequence: Synthetic oligonucleotide
ucguaaguuaacaccagccuu

SEQ ID NO: 29171 - RNA, 21 nt, Artificial Sequence
  Description of Artificial Sequence: Synthetic oligonucleotide
uucguaaguuaacaccagcuu

SEQ ID NO: 29172 - RNA, 21 nt, Artificial Sequence
  Description of Artificial Sequence: Synthetic oligonucleotide
ugucguaaguuaacaccaguu

SEQ ID NO: 29173 - RNA, 21 nt, Artificial Sequence
  Description of Artificial Sequence: Synthetic oligonucleotide
uagucguaaguuaacaccauu

SEQ ID NO: 29174 - RNA, 21 nt, Artificial Sequence
  Description of Artificial Sequence: Synthetic oligonucleotide
uaagucguaaguuaacaccuu

SEQ ID NO: 29175 - RNA, 21 nt, Artificial Sequence
  Description of Artificial Sequence: Synthetic oligonucleotide
ugaagucguaaguuaacacuu

SEQ ID NO: 29176 - RNA, 21 nt, Artificial Sequence
  Description of Artificial Sequence: Synthetic oligonucleotide
uugaagucguaaguuaacauu

SEQ ID NO: 29177 - RNA, 21 nt, Artificial Sequence
  Description of Artificial Sequence: Synthetic oligonucleotide
ugugaagucguaaguuaacuu

SEQ ID NO: 29178 - RNA, 21 nt, Artificial Sequence
  Description of Artificial Sequence: Synthetic oligonucleotide
uagugaagucguaaguuaauu

SEQ ID NO: 29179 - RNA, 21 nt, Artificial Sequence
  Description of Artificial Sequence: Synthetic oligonucleotide
uuagugaagucguaaguuauu

SEQ ID NO: 29180 - RNA, 21 nt, Artificial Sequence
  Description of Artificial Sequence: Synthetic oligonucleotide
uuuagugaagucguaaguuuu

SEQ ID NO: 29181 - RNA, 21 nt, Artificial Sequence
  Description of Artificial Sequence: Synthetic oligonucleotide
uguuagugaagucguaaguuu

SEQ ID NO: 29182 - RNA, 21 nt, Artificial Sequence
  Description of Artificial Sequence: Synthetic oligonucleotide
uaguuagugaagucguaaguu

SEQ ID NO: 29183 - RNA, 21 nt, Artificial Sequence
  Description of Artificial Sequence: Synthetic oligonucleotide
ucaguuagugaagucguaauu

SEQ ID NO: 29184 - RNA, 21 nt, Artificial Sequence
  Description of Artificial Sequence: Synthetic oligonucleotide
uacaguuagugaagucguauu

SEQ ID NO: 29185 - RNA, 21 nt, Artificial Sequence
  Description of Artificial Sequence: Synthetic oligonucleotide
ucacaguuagugaagucguuu

SEQ ID NO: 29186 - RNA, 21 nt, Artificial Sequence
  Description of Artificial Sequence: Synthetic oligonucleotide
uucacaguuagugaagucguu

SEQ ID NO: 29187 - RNA, 21 nt, Artificial Sequence
  Description of Artificial Sequence: Synthetic oligonucleotide
ugucacaguuagugaagucuu

SEQ ID NO: 29188 - RNA, 21 nt, Artificial Sequence
  Description of Artificial Sequence: Synthetic oligonucleotide
uagucacaguuagugaaguuu

SEQ ID NO: 29189 - RNA, 21 nt, Artificial Sequence
  Description of Artificial Sequence: Synthetic oligonucleotide
uaagucacaguuagugaaguu

SEQ ID NO: 29190 - RNA, 21 nt, Artificial Sequence
  Description of Artificial Sequence: Synthetic oligonucleotide
uaaagucacaguuagugaauu

SEQ ID NO: 29191 - RNA, 21 nt, Artificial Sequence
  Description of Artificial Sequence: Synthetic oligonucleotide
ucaaagucacaguuagugauu

SEQ ID NO: 29192 - RNA, 21 nt, Artificial Sequence
  Description of Artificial Sequence: Synthetic oligonucleotide
uucaaagucacaguuaguguu

SEQ ID NO: 29193 - RNA, 21 nt, Artificial Sequence
  Description of Artificial Sequence: Synthetic oligonucleotide
ucucaaagucacaguuaguuu

SEQ ID NO: 29194 - RNA, 21 nt, Artificial Sequence
  Description of Artificial Sequence: Synthetic oligonucleotide
uucucaaagucacaguuaguu

SEQ ID NO: 29195 - RNA, 21 nt, Artificial Sequence
  Description of Artificial Sequence: Synthetic oligonucleotide
uuucucaaagucacaguuauu

SEQ ID NO: 29196 - RNA, 21 nt, Artificial Sequence
  Description of Artificial Sequence: Synthetic oligonucleotide
ucuucucaaagucacaguuuu

SEQ ID NO: 29197 - RNA, 21 nt, Artificial Sequence
  Description of Artificial Sequence: Synthetic oligonucleotide
uucuucucaaagucacaguuu

SEQ ID NO: 29198 - RNA, 21 nt, Artificial Sequence
  Description of Artificial Sequence: Synthetic oligonucleotide
uaucuucucaaagucacaguu

SEQ ID NO: 29199 - RNA, 21 nt, Artificial Sequence
  Description of Artificial Sequence: Synthetic oligonucleotide
uaaucuucucaaagucacauu

SEQ ID NO: 29200 - RNA, 21 nt, Artificial Sequence
  Description of Artificial Sequence: Synthetic oligonucleotide
uuaaucuucucaaagucacuu

SEQ ID NO: 29201 - RNA, 21 nt, Artificial Sequence
  Description of Artificial Sequence: Synthetic oligonucleotide
uuuaaucuucucaaagucauu

SEQ ID NO: 29202 - RNA, 21 nt, Artificial Sequence
  Description of Artificial Sequence: Synthetic oligonucleotide
uuuuaaucuucucaaagucuu

SEQ ID NO: 29203 - RNA, 21 nt, Artificial Sequence
  Description of Artificial Sequence: Synthetic oligonucleotide
ucuuuaaucuucucaaaguuu

SEQ ID NO: 29204 - RNA, 21 nt, Artificial Sequence
  Description of Artificial Sequence: Synthetic oligonucleotide
ugcuuuaaucuucucaaaguu

SEQ ID NO: 29205 - RNA, 21 nt, Artificial Sequence
  Description of Artificial Sequence: Synthetic oligonucleotide
uugcuuuaaucuucucaaauu

SEQ ID NO: 29206 - RNA, 21 nt, Artificial Sequence
  Description of Artificial Sequence: Synthetic oligonucleotide
ucugcuuuaaucuucucaauu

SEQ ID NO: 29207 - RNA, 21 nt, Artificial Sequence
  Description of Artificial Sequence: Synthetic oligonucleotide
ugcugcuuuaaucuucucauu

SEQ ID NO: 29208 - RNA, 21 nt, Artificial Sequence
  Description of Artificial Sequence: Synthetic oligonucleotide
uggcugcuuuaaucuucucuu

SEQ ID NO: 29209 - RNA, 21 nt, Artificial Sequence
  Description of Artificial Sequence: Synthetic oligonucleotide
uaggcugcuuuaaucuucuuu

SEQ ID NO: 29210 - RNA, 21 nt, Artificial Sequence
  Description of Artificial Sequence: Synthetic oligonucleotide
uuaggcugcuuuaaucuucuu

SEQ ID NO: 29211 - RNA, 21 nt, Artificial Sequence
  Description of Artificial Sequence: Synthetic oligonucleotide
uauaggcugcuuuaaucuuuu

SEQ ID NO: 29212 - RNA, 21 nt, Artificial Sequence
  Description of Artificial Sequence: Synthetic oligonucleotide
ugauaggcugcuuuaaucuuu

SEQ ID NO: 29213 - RNA, 21 nt, Artificial Sequence
  Description of Artificial Sequence: Synthetic oligonucleotide
uagauaggcugcuuuaaucuu

SEQ ID NO: 29214 - RNA, 21 nt, Artificial Sequence
  Description of Artificial Sequence: Synthetic oligonucleotide
ugagauaggcugcuuuaauuu

SEQ ID NO: 29215 - RNA, 21 nt, Artificial Sequence
  Description of Artificial Sequence: Synthetic oligonucleotide
uugagauaggcugcuuuaauu

SEQ ID NO: 29216 - RNA, 21 nt, Artificial Sequence
  Description of Artificial Sequence: Synthetic oligonucleotide
ucugagauaggcugcuuuauu

SEQ ID NO: 29217 - RNA, 21 nt, Artificial Sequence
  Description of Artificial Sequence: Synthetic oligonucleotide
uacugagauaggcugcuuuuu

SEQ ID NO: 29218 - RNA, 21 nt, Artificial Sequence
  Description of Artificial Sequence: Synthetic oligonucleotide
uuacugagauaggcugcuuuu

SEQ ID NO: 29219 - RNA, 21 nt, Artificial Sequence
  Description of Artificial Sequence: Synthetic oligonucleotide
uguacugagauaggcugcuuu

SEQ ID NO: 29220 - RNA, 21 nt, Artificial Sequence
  Description of Artificial Sequence: Synthetic oligonucleotide
uaguacugagauaggcugcuu

SEQ ID NO: 29221 - RNA, 21 nt, Artificial Sequence
  Description of Artificial Sequence: Synthetic oligonucleotide
uuaguacugagauaggcuguu

SEQ ID NO: 29222 - RNA, 21 nt, Artificial Sequence
  Description of Artificial Sequence: Synthetic oligonucleotide
uauaguacugagauaggcuuu

SEQ ID NO: 29223 - RNA, 21 nt, Artificial Sequence
  Description of Artificial Sequence: Synthetic oligonucleotide
uaauaguacugagauaggcuu

SEQ ID NO: 29224 - RNA, 21 nt, Artificial Sequence
  Description of Artificial Sequence: Synthetic oligonucleotide
uaaauaguacugagauagguu

SEQ ID NO: 29225 - RNA, 21 nt, Artificial Sequence
  Description of Artificial Sequence: Synthetic oligonucleotide
ugaaauaguacugagauaguu

SEQ ID NO: 29226 - RNA, 21 nt, Artificial Sequence
  Description of Artificial Sequence: Synthetic oligonucleotide
uagaaauaguacugagauauu

SEQ ID NO: 29227 - RNA, 21 nt, Artificial Sequence
  Description of Artificial Sequence: Synthetic oligonucleotide
uuagaaauaguacugagauuu

SEQ ID NO: 29228 - RNA, 21 nt, Artificial Sequence
  Description of Artificial Sequence: Synthetic oligonucleotide
uuuagaaauaguacugagauu

SEQ ID NO: 29229 - RNA, 21 nt, Artificial Sequence
  Description of Artificial Sequence: Synthetic oligonucleotide
uuuuagaaauaguacugaguu

SEQ ID NO: 29230 - RNA, 21 nt, Artificial Sequence
  Description of Artificial Sequence: Synthetic oligonucleotide
ucuuuagaaauaguacugauu

SEQ ID NO: 29231 - RNA, 21 nt, Artificial Sequence
  Description of Artificial Sequence: Synthetic oligonucleotide
uucuuuagaaauaguacuguu

SEQ ID NO: 29232 - RNA, 21 nt, Artificial Sequence
  Description of Artificial Sequence: Synthetic oligonucleotide
ugucuuuagaaauaguacuuu

SEQ ID NO: 29233 - RNA, 21 nt, Artificial Sequence
  Description of Artificial Sequence: Synthetic oligonucleotide
uggucuuuagaaauaguacuu

SEQ ID NO: 29234 - RNA, 21 nt, Artificial Sequence
  Description of Artificial Sequence: Synthetic oligonucleotide
uaggucuuuagaaauaguauu

SEQ ID NO: 29235 - RNA, 21 nt, Artificial Sequence
  Description of Artificial Sequence: Synthetic oligonucleotide
ucaggucuuuagaaauaguuu

SEQ ID NO: 29236 - RNA, 21 nt, Artificial Sequence
  Description of Artificial Sequence: Synthetic oligonucleotide
uucaggucuuuagaaauaguu

SEQ ID NO: 29237 - RNA, 21 nt, Artificial Sequence
  Description of Artificial Sequence: Synthetic oligonucleotide
uaucaggucuuuagaaauauu

SEQ ID NO: 29238 - RNA, 21 nt, Artificial Sequence
  Description of Artificial Sequence: Synthetic oligonucleotide
uaaucaggucuuuagaaauuu

SEQ ID NO: 29239 - RNA, 21 nt, Artificial Sequence
  Description of Artificial Sequence: Synthetic oligonucleotide
uuaaucaggucuuuagaaauu

SEQ ID NO: 29240 - RNA, 21 nt, Artificial Sequence
  Description of Artificial Sequence: Synthetic oligonucleotide
uguaaucaggucuuuagaauu

SEQ ID NO: 29241 - RNA, 21 nt, Artificial Sequence
  Description of Artificial Sequence: Synthetic oligonucleotide
uuguaaucaggucuuuagauu

SEQ ID NO: 29242 - RNA, 21 nt, Artificial Sequence
  Description of Artificial Sequence: Synthetic oligonucleotide
uauguaaucaggucuuuaguu

SEQ ID NO: 29243 - RNA, 21 nt, Artificial Sequence
  Description of Artificial Sequence: Synthetic oligonucleotide
uuauguaaucaggucuuuauu

SEQ ID NO: 29244 - RNA, 21 nt, Artificial Sequence
  Description of Artificial Sequence: Synthetic oligonucleotide
uauauguaaucaggucuuuuu

SEQ ID NO: 29245 - RNA, 21 nt, Artificial Sequence
  Description of Artificial Sequence: Synthetic oligonucleotide
uuauauguaaucaggucuuuu

SEQ ID NO: 29246 - RNA, 21 nt, Artificial Sequence
  Description of Artificial Sequence: Synthetic oligonucleotide
uauauauguaaucaggucuuu

SEQ ID NO: 29247 - RNA, 21 nt, Artificial Sequence
  Description of Artificial Sequence: Synthetic oligonucleotide
ucauauauguaaucaggucuu

SEQ ID NO: 29248 - RNA, 21 nt, Artificial Sequence
  Description of Artificial Sequence: Synthetic oligonucleotide
uucauauauguaaucagguuu

SEQ ID NO: 29249 - RNA, 21 nt, Artificial Sequence
  Description of Artificial Sequence: Synthetic oligonucleotide
ucucauauauguaaucagguu

SEQ ID NO: 29250 - RNA, 21 nt, Artificial Sequence
  Description of Artificial Sequence: Synthetic oligonucleotide
uacucauauauguaaucaguu

SEQ ID NO: 29251 - RNA, 21 nt, Artificial Sequence
  Description of Artificial Sequence: Synthetic oligonucleotide
ucacucauauauguaaucauu

SEQ ID NO: 29252 - RNA, 21 nt, Artificial Sequence
  Description of Artificial Sequence: Synthetic oligonucleotide
uccacucauauauguaaucuu

SEQ ID NO: 29253 - RNA, 21 nt, Artificial Sequence
  Description of Artificial Sequence: Synthetic oligonucleotide
ucccacucauauauguaauuu

SEQ ID NO: 29254 - RNA, 21 nt, Artificial Sequence
  Description of Artificial Sequence: Synthetic oligonucleotide
uucccacucauauauguaauu

SEQ ID NO: 29255 - RNA, 21 nt, Artificial Sequence
  Description of Artificial Sequence: Synthetic oligonucleotide
ugucccacucauauauguauu

SEQ ID NO: 29256 - RNA, 21 nt, Artificial Sequence
  Description of Artificial Sequence: Synthetic oligonucleotide
uggucccacucauauauguuu

SEQ ID NO: 29257 - RNA, 21 nt, Artificial Sequence
  Description of Artificial Sequence: Synthetic oligonucleotide
uuggucccacucauauauguu

SEQ ID NO: 29258 - RNA, 21 nt, Artificial Sequence
  Description of Artificial Sequence: Synthetic oligonucleotide
uuuggucccacucauauauuu

SEQ ID NO: 29259 - RNA, 21 nt, Artificial Sequence
  Description of Artificial Sequence: Synthetic oligonucleotide
uuuuggucccacucauauauu

SEQ ID NO: 29260 - RNA, 21 nt, Artificial Sequence
  Description of Artificial Sequence: Synthetic oligonucleotide
uuuuuggucccacucauauuu

SEQ ID NO: 29261 - RNA, 21 nt, Artificial Sequence
  Description of Artificial Sequence: Synthetic oligonucleotide
ucuuuuggucccacucauauu

SEQ ID NO: 29262 - RNA, 21 nt, Artificial Sequence
  Description of Artificial Sequence: Synthetic oligonucleotide
uacuuuuggucccacucauuu

SEQ ID NO: 29263 - RNA, 21 nt, Artificial Sequence
  Description of Artificial Sequence: Synthetic oligonucleotide
uuacuuuuggucccacucauu

SEQ ID NO: 29264 - RNA, 21 nt, Artificial Sequence
  Description of Artificial Sequence: Synthetic oligonucleotide
uguacuuuuggucccacucuu

SEQ ID NO: 29265 - RNA, 21 nt, Artificial Sequence
  Description of Artificial Sequence: Synthetic oligonucleotide
ugguacuuuuggucccacuuu

SEQ ID NO: 29266 - RNA, 21 nt, Artificial Sequence
  Description of Artificial Sequence: Synthetic oligonucleotide
ucgguacuuuuggucccacuu

SEQ ID NO: 29267 - RNA, 21 nt, Artificial Sequence
  Description of Artificial Sequence: Synthetic oligonucleotide
uucgguacuuuuggucccauu

SEQ ID NO: 29268 - RNA, 21 nt, Artificial Sequence
  Description of Artificial Sequence: Synthetic oligonucleotide
ucucgguacuuuuggucccuu

SEQ ID NO: 29269 - RNA, 21 nt, Artificial Sequence
  Description of Artificial Sequence: Synthetic oligonucleotide
uacucgguacuuuugguccuu

SEQ ID NO: 29270 - RNA, 21 nt, Artificial Sequence
  Description of Artificial Sequence: Synthetic oligonucleotide
uaacucgguacuuuuggucuu

SEQ ID NO: 29271 - RNA, 21 nt, Artificial Sequence
  Description of Artificial Sequence: Synthetic oligonucleotide
ugaacucgguacuuuugguuu

SEQ ID NO: 29272 - RNA, 21 nt, Artificial Sequence
  Description of Artificial Sequence: Synthetic oligonucleotide
uugaacucgguacuuuugguu

SEQ ID NO: 29273 - RNA, 21 nt, Artificial Sequence
  Description of Artificial Sequence: Synthetic oligonucleotide
uuugaacucgguacuuuuguu

SEQ ID NO: 29274 - RNA, 21 nt, Artificial Sequence
  Description of Artificial Sequence: Synthetic oligonucleotide
uguugaacucgguacuuuuuu

SEQ ID NO: 29275 - RNA, 21 nt, Artificial Sequence
  Description of Artificial Sequence: Synthetic oligonucleotide
uuguugaacucgguacuuuuu

SEQ ID NO: 29276 - RNA, 21 nt, Artificial Sequence
  Description of Artificial Sequence: Synthetic oligonucleotide
uuuguugaacucgguacuuuu

SEQ ID NO: 29277 - RNA, 21 nt, Artificial Sequence
  Description of Artificial Sequence: Synthetic oligonucleotide
uguuguugaacucgguacuuu

SEQ ID NO: 29278 - RNA, 21 nt, Artificial Sequence
  Description of Artificial Sequence: Synthetic oligonucleotide
uuguuguugaacucgguacuu

SEQ ID NO: 29279 - RNA, 21 nt, Artificial Sequence
  Description of Artificial Sequence: Synthetic oligonucleotide
uguguuguugaacucgguauu

SEQ ID NO: 29280 - RNA, 21 nt, Artificial Sequence
  Description of Artificial Sequence: Synthetic oligonucleotide
ugguguuguugaacucgguuu

SEQ ID NO: 29281 - RNA, 21 nt, Artificial Sequence
  Description of Artificial Sequence: Synthetic oligonucleotide
ucgguguuguugaacucgguu

SEQ ID NO: 29282 - RNA, 21 nt, Artificial Sequence
  Description of Artificial Sequence: Synthetic oligonucleotide
uacgguguuguugaacucguu

SEQ ID NO: 29283 - RNA, 21 nt, Artificial Sequence
  Description of Artificial Sequence: Synthetic oligonucleotide
ugacgguguuguugaacucuu

SEQ ID NO: 29284 - RNA, 21 nt, Artificial Sequence
  Description of Artificial Sequence: Synthetic oligonucleotide
uagacgguguuguugaacuuu

SEQ ID NO: 29285 - RNA, 21 nt, Artificial Sequence
  Description of Artificial Sequence: Synthetic oligonucleotide
ugagacgguguuguugaacuu

SEQ ID NO: 29286 - RNA, 21 nt, Artificial Sequence
  Description of Artificial Sequence: Synthetic oligonucleotide
uagagacgguguuguugaauu

SEQ ID NO: 29287 - RNA, 21 nt, Artificial Sequence
  Description of Artificial Sequence: Synthetic oligonucleotide
uaagagacgguguuguugauu

SEQ ID NO: 29288 - RNA, 21 nt, Artificial Sequence
  Description of Artificial Sequence: Synthetic oligonucleotide
ucaagagacgguguuguuguu

SEQ ID NO: 29289 - RNA, 21 nt, Artificial Sequence
  Description of Artificial Sequence: Synthetic oligonucleotide
uacaagagacgguguuguuuu

SEQ ID NO: 29290 - RNA, 21 nt, Artificial Sequence
  Description of Artificial Sequence: Synthetic oligonucleotide
uuacaagagacgguguuguuu

SEQ ID NO: 29291 - RNA, 21 nt, Artificial Sequence
  Description of Artificial Sequence: Synthetic oligonucleotide
ucuacaagagacgguguuguu

SEQ ID NO: 29292 - RNA, 21 nt, Artificial Sequence
  Description of Artificial Sequence: Synthetic oligonucleotide
ugcuacaagagacgguguuuu

SEQ ID NO: 29293 - RNA, 21 nt, Artificial Sequence
  Description of Artificial Sequence: Synthetic oligonucleotide
uugcuacaagagacgguguuu

SEQ ID NO: 29294 - RNA, 21 nt, Artificial Sequence
  Description of Artificial Sequence: Synthetic oligonucleotide
uuugcuacaagagacgguguu

SEQ ID NO: 29295 - RNA, 21 nt, Artificial Sequence
  Description of Artificial Sequence: Synthetic oligonucleotide
uauugcuacaagagacgguuu

SEQ ID NO: 29296 - RNA, 21 nt, Artificial Sequence
  Description of Artificial Sequence: Synthetic oligonucleotide
ugauugcuacaagagacgguu

SEQ ID NO: 29297 - RNA, 21 nt, Artificial Sequence
  Description of Artificial Sequence: Synthetic oligonucleotide
ucgauugcuacaagagacguu

SEQ ID NO: 29298 - RNA, 21 nt, Artificial Sequence
  Description of Artificial Sequence: Synthetic oligonucleotide
uccgauugcuacaagagacuu

SEQ ID NO: 29299 - RNA, 21 nt, Artificial Sequence
  Description of Artificial Sequence: Synthetic oligonucleotide
ugccgauugcuacaagagauu

SEQ ID NO: 29300 - RNA, 21 nt, Artificial Sequence
  Description of Artificial Sequence: Synthetic oligonucleotide
uggccgauugcuacaagaguu

SEQ ID NO: 29301 - RNA, 21 nt, Artificial Sequence
  Description of Artificial Sequence: Synthetic oligonucleotide
uuggccgauugcuacaagauu

SEQ ID NO: 29302 - RNA, 21 nt, Artificial Sequence
  Description of Artificial Sequence: Synthetic oligonucleotide
uguggccgauugcuacaaguu

SEQ ID NO: 29303 - RNA, 21 nt, Artificial Sequence
  Description of Artificial Sequence: Synthetic oligonucleotide
uuguggccgauugcuacaauu

SEQ ID NO: 29304 - RNA, 21 nt, Artificial Sequence
  Description of Artificial Sequence: Synthetic oligonucleotide
uauguggccgauugcuacauu

SEQ ID NO: 29305 - RNA, 21 nt, Artificial Sequence
  Description of Artificial Sequence: Synthetic oligonucleotide
uaauguggccgauugcuacuu

SEQ ID NO: 29306 - RNA, 21 nt, Artificial Sequence
  Description of Artificial Sequence: Synthetic oligonucleotide
ucaauguggccgauugcuauu

SEQ ID NO: 29307 - RNA, 21 nt, Artificial Sequence
  Description of Artificial Sequence: Synthetic oligonucleotide
ugcaauguggccgauugcuuu

SEQ ID NO: 29308 - RNA, 21 nt, Artificial Sequence
  Description of Artificial Sequence: Synthetic oligonucleotide
uggcaauguggccgauugcuu

SEQ ID NO: 29309 - RNA, 21 nt, Artificial Sequence
  Description of Artificial Sequence: Synthetic oligonucleotide
uaggcaauguggccgauuguu

SEQ ID NO: 29310 - RNA, 21 nt, Artificial Sequence
  Description of Artificial Sequence: Synthetic oligonucleotide
uaaggcaauguggccgauuuu

SEQ ID NO: 29311 - RNA, 21 nt, Artificial Sequence
  Description of Artificial Sequence: Synthetic oligonucleotide
uuaaggcaauguggccgauuu

SEQ ID NO: 29312 - RNA, 21 nt, Artificial Sequence
  Description of Artificial Sequence: Synthetic oligonucleotide
uguaaggcaauguggccgauu

SEQ ID NO: 29313 - RNA, 21 nt, Artificial Sequence
  Description of Artificial Sequence: Synthetic oligonucleotide
uaguaaggcaauguggccguu

SEQ ID NO: 29314 - RNA, 21 nt, Artificial Sequence
  Description of Artificial Sequence: Synthetic oligonucleotide
ucaguaaggcaauguggccuu

SEQ ID NO: 29315 - RNA, 21 nt, Artificial Sequence
  Description of Artificial Sequence: Synthetic oligonucleotide
uucaguaaggcaauguggcuu

SEQ ID NO: 29316 - RNA, 21 nt, Artificial Sequence
  Description of Artificial Sequence: Synthetic oligonucleotide
uuucaguaaggcaaugugguu

SEQ ID NO: 29317 - RNA, 21 nt, Artificial Sequence
  Description of Artificial Sequence: Synthetic oligonucleotide
uuuucaguaaggcaauguguu

SEQ ID NO: 29318 - RNA, 21 nt, Artificial Sequence
  Description of Artificial Sequence: Synthetic oligonucleotide
uauuucaguaaggcaauguuu

SEQ ID NO: 29319 - RNA, 21 nt, Artificial Sequence
  Description of Artificial Sequence: Synthetic oligonucleotide
ugauuucaguaaggcaauguu

SEQ ID NO: 29320 - RNA, 21 nt, Artificial Sequence
  Description of Artificial Sequence: Synthetic oligonucleotide
uggauuucaguaaggcaauuu

SEQ ID NO: 29321 - RNA, 21 nt, Artificial Sequence
  Description of Artificial Sequence: Synthetic oligonucleotide
uuggauuucaguaaggcaauu

SEQ ID NO: 29322 - RNA, 21 nt, Artificial Sequence
  Description of Artificial Sequence: Synthetic oligonucleotide
ucuggauuucaguaaggcauu

SEQ ID NO: 29323 - RNA, 21 nt, Artificial Sequence
  Description of Artificial Sequence: Synthetic oligonucleotide
uucuggauuucaguaaggcuu

SEQ ID NO: 29324 - RNA, 21 nt, Artificial Sequence
  Description of Artificial Sequence: Synthetic oligonucleotide
ucucuggauuucaguaagguu

SEQ ID NO: 29325 - RNA, 21 nt, Artificial Sequence
  Description of Artificial Sequence: Synthetic oligonucleotide
ugcucuggauuucaguaaguu

SEQ ID NO: 29326 - RNA, 21 nt, Artificial Sequence
  Description of Artificial Sequence: Synthetic oligonucleotide
uggcucuggauuucaguaauu

SEQ ID NO: 29327 - RNA, 21 nt, Artificial Sequence
  Description of Artificial Sequence: Synthetic oligonucleotide
uaggcucuggauuucaguauu

SEQ ID NO: 29328 - RNA, 21 nt, Artificial Sequence
  Description of Artificial Sequence: Synthetic oligonucleotide
uuaggcucuggauuucaguuu

SEQ ID NO: 29329 - RNA, 21 nt, Artificial Sequence
  Description of Artificial Sequence: Synthetic oligonucleotide
uuuaggcucuggauuucaguu

SEQ ID NO: 29330 - RNA, 21 nt, Artificial Sequence
  Description of Artificial Sequence: Synthetic oligonucleotide
uguuaggcucuggauuucauu

SEQ ID NO: 29331 - RNA, 21 nt, Artificial Sequence
  Description of Artificial Sequence: Synthetic oligonucleotide
ugguuaggcucuggauuucuu

SEQ ID NO: 29332 - RNA, 21 nt, Artificial Sequence
  Description of Artificial Sequence: Synthetic oligonucleotide
uagguuaggcucuggauuuuu

SEQ ID NO: 29333 - RNA, 21 nt, Artificial Sequence
  Description of Artificial Sequence: Synthetic oligonucleotide
uaagguuaggcucuggauuuu

SEQ ID NO: 29334 - RNA, 21 nt, Artificial Sequence
  Description of Artificial Sequence: Synthetic oligonucleotide
ugaagguuaggcucuggauuu

SEQ ID NO: 29335 - RNA, 21 nt, Artificial Sequence
  Description of Artificial Sequence: Synthetic oligonucleotide
uugaagguuaggcucuggauu

SEQ ID NO: 29336 - RNA, 21 nt, Artificial Sequence
  Description of Artificial Sequence: Synthetic oligonucleotide
uuugaagguuaggcucugguu

SEQ ID NO: 29337 - RNA, 21 nt, Artificial Sequence
  Description of Artificial Sequence: Synthetic oligonucleotide
uauugaagguuaggcucuguu

SEQ ID NO: 29338 - RNA, 21 nt, Artificial Sequence
  Description of Artificial Sequence: Synthetic oligonucleotide
ugauugaagguuaggcucuuu

SEQ ID NO: 29339 - RNA, 21 nt, Artificial Sequence
  Description of Artificial Sequence: Synthetic oligonucleotide
uggauugaagguuaggcucuu

SEQ ID NO: 29340 - RNA, 21 nt, Artificial Sequence
  Description of Artificial Sequence: Synthetic oligonucleotide
ugggauugaagguuaggcuuu

SEQ ID NO: 29341 - RNA, 21 nt, Artificial Sequence
  Description of Artificial Sequence: Synthetic oligonucleotide
uugggauugaagguuaggcuu

SEQ ID NO: 29342 - RNA, 21 nt, Artificial Sequence
  Description of Artificial Sequence: Synthetic oligonucleotide
ugugggauugaagguuagguu

SEQ ID NO: 29343 - RNA, 21 nt, Artificial Sequence
  Description of Artificial Sequence: Synthetic oligonucleotide
uggugggauugaagguuaguu

SEQ ID NO: 29344 - RNA, 21 nt, Artificial Sequence
  Description of Artificial Sequence: Synthetic oligonucleotide
ucggugggauugaagguuauu

SEQ ID NO: 29345 - RNA, 21 nt, Artificial Sequence
  Description of Artificial Sequence: Synthetic oligonucleotide
ugcggugggauugaagguuuu

SEQ ID NO: 29346 - RNA, 21 nt, Artificial Sequence
  Description of Artificial Sequence: Synthetic oligonucleotide
uggcggugggauugaagguuu

SEQ ID NO: 29347 - RNA, 21 nt, Artificial Sequence
  Description of Artificial Sequence: Synthetic oligonucleotide
ucggcggugggauugaagguu

SEQ ID NO: 29348 - RNA, 21 nt, Artificial Sequence
  Description of Artificial Sequence: Synthetic oligonucleotide
uccggcggugggauugaaguu

SEQ ID NO: 29349 - RNA, 21 nt, Artificial Sequence
  Description of Artificial Sequence: Synthetic oligonucleotide
ugccggcggugggauugaauu

SEQ ID NO: 29350 - RNA, 21 nt, Artificial Sequence
  Description of Artificial Sequence: Synthetic oligonucleotide
uagccggcggugggauugauu

SEQ ID NO: 29351 - RNA, 21 nt, Artificial Sequence
  Description of Artificial Sequence: Synthetic oligonucleotide
ucagccggcggugggauuguu

SEQ ID NO: 29352 - RNA, 21 nt, Artificial Sequence
  Description of Artificial Sequence: Synthetic oligonucleotide
ugcagccggcggugggauuuu

SEQ ID NO: 29353 - RNA, 21 nt, Artificial Sequence
  Description of Artificial Sequence: Synthetic oligonucleotide
ucgcagccggcggugggauuu

SEQ ID NO: 29354 - RNA, 21 nt, Artificial Sequence
  Description of Artificial Sequence: Synthetic oligonucleotide
ugcgcagccggcggugggauu

SEQ ID NO: 29355 - RNA, 21 nt, Artificial Sequence
  Description of Artificial Sequence: Synthetic oligonucleotide
ucgcgcagccggcgguggguu

SEQ ID NO: 29356 - RNA, 21 nt, Artificial Sequence
  Description of Artificial Sequence: Synthetic oligonucleotide
uacgcgcagccggcggugguu

SEQ ID NO: 29357 - RNA, 21 nt, Artificial Sequence
  Description of Artificial Sequence: Synthetic oligonucleotide
ugacgcgcagccggcgguguu

SEQ ID NO: 29358 - RNA, 21 nt, Artificial Sequence
  Description of Artificial Sequence: Synthetic oligonucleotide
ucgacgcgcagccggcgguuu

SEQ ID NO: 29359 - RNA, 21 nt, Artificial Sequence
  Description of Artificial Sequence: Synthetic oligonucleotide
ugcgacgcgcagccggcgguu

SEQ ID NO: 29360 - RNA, 21 nt, Artificial Sequence
  Description of Artificial Sequence: Synthetic oligonucleotide
uagcgacgcgcagccggcguu

SEQ ID NO: 29361 - RNA, 21 nt, Artificial Sequence
  Description of Artificial Sequence: Synthetic oligonucleotide
ugagcgacgcgcagccggcuu

SEQ ID NO: 29362 - RNA, 21 nt, Artificial Sequence
  Description of Artificial Sequence: Synthetic oligonucleotide
ucgagcgacgcgcagccgguu

SEQ ID NO: 29363 - RNA, 21 nt, Artificial Sequence
  Description of Artificial Sequence: Synthetic oligonucleotide
ugcgagcgacgcgcagccguu

SEQ ID NO: 29364 - RNA, 21 nt, Artificial Sequence
  Description of Artificial Sequence: Synthetic oligonucleotide
uggcgagcgacgcgcagccuu

SEQ ID NO: 29365 - RNA, 21 nt, Artificial Sequence
  Description of Artificial Sequence: Synthetic oligonucleotide
uuggcgagcgacgcgcagcuu

SEQ ID NO: 29366 - RNA, 21 nt, Artificial Sequence
  Description of Artificial Sequence: Synthetic oligonucleotide
uuuggcgagcgacgcgcaguu

SEQ ID NO: 29367 - RNA, 21 nt, Artificial Sequence
  Description of Artificial Sequence: Synthetic oligonucleotide
uuuuggcgagcgacgcgcauu

SEQ ID NO: 29368 - RNA, 21 nt, Artificial Sequence
  Description of Artificial Sequence: Synthetic oligonucleotide
ucuuuggcgagcgacgcgcuu

SEQ ID NO: 29369 - RNA, 21 nt, Artificial Sequence
  Description of Artificial Sequence: Synthetic oligonucleotide
uucuuuggcgagcgacgcguu

SEQ ID NO: 29370 - RNA, 21 nt, Artificial Sequence
  Description of Artificial Sequence: Synthetic oligonucleotide
uuucuuuggcgagcgacgcuu

SEQ ID NO: 29371 - RNA, 21 nt, Artificial Sequence
  Description of Artificial Sequence: Synthetic oligonucleotide
uuuucuuuggcgagcgacguu

SEQ ID NO: 29372 - RNA, 21 nt, Artificial Sequence
  Description of Artificial Sequence: Synthetic oligonucleotide
uauuucuuuggcgagcgacuu

SEQ ID NO: 29373 - RNA, 21 nt, Artificial Sequence
  Description of Artificial Sequence: Synthetic oligonucleotide
ucauuucuuuggcgagcgauu

SEQ ID NO: 29374 - RNA, 21 nt, Artificial Sequence
  Description of Artificial Sequence: Synthetic oligonucleotide
uacauuucuuuggcgagcguu

SEQ ID NO: 29375 - RNA, 21 nt, Artificial Sequence
  Description of Artificial Sequence: Synthetic oligonucleotide
uaacauuucuuuggcgagcuu

SEQ ID NO: 29376 - RNA, 21 nt, Artificial Sequence
  Description of Artificial Sequence: Synthetic oligonucleotide
ugaacauuucuuuggcgaguu

SEQ ID NO: 29377 - RNA, 21 nt, Artificial Sequence
  Description of Artificial Sequence: Synthetic oligonucleotide
ucgaacauuucuuuggcgauu

SEQ ID NO: 29378 - RNA, 21 nt, Artificial Sequence
  Description of Artificial Sequence: Synthetic oligonucleotide
ugcgaacauuucuuuggcguu

SEQ ID NO: 29379 - RNA, 21 nt, Artificial Sequence
  Description of Artificial Sequence: Synthetic oligonucleotide
uggcgaacauuucuuuggcuu

SEQ ID NO: 29380 - RNA, 21 nt, Artificial Sequence
  Description of Artificial Sequence: Synthetic oligonucleotide
uuggcgaacauuucuuugguu

SEQ ID NO: 29381 - RNA, 21 nt, Artificial Sequence
  Description of Artificial Sequence: Synthetic oligonucleotide
uauggcgaacauuucuuuguu

SEQ ID NO: 29382 - RNA, 21 nt, Artificial Sequence
  Description of Artificial Sequence: Synthetic oligonucleotide
ucauggcgaacauuucuuuuu

SEQ ID NO: 29383 - RNA, 21 nt, Artificial Sequence
  Description of Artificial Sequence: Synthetic oligonucleotide
uucauggcgaacauuucuuuu

SEQ ID NO: 29384 - RNA, 21 nt, Artificial Sequence
  Description of Artificial Sequence: Synthetic oligonucleotide
uuucauggcgaacauuucuuu

SEQ ID NO: 29385 - RNA, 21 nt, Artificial Sequence
  Description of Artificial Sequence: Synthetic oligonucleotide
uuuucauggcgaacauuucuu

SEQ ID NO: 29386 - RNA, 21 nt, Artificial Sequence
  Description of Artificial Sequence: Synthetic oligonucleotide
uuuuucauggcgaacauuuuu

SEQ ID NO: 29387 - RNA, 21 nt, Artificial Sequence
  Description of Artificial Sequence: Synthetic oligonucleotide
uguuuucauggcgaacauuuu

SEQ ID NO: 29388 - RNA, 21 nt, Artificial Sequence
  Description of Artificial Sequence: Synthetic oligonucleotide
uaguuuucauggcgaacauuu

SEQ ID NO: 29389 - RNA, 21 nt, Artificial Sequence
  Description of Artificial Sequence: Synthetic oligonucleotide
uuaguuuucauggcgaacauu

SEQ ID NO: 29390 - RNA, 21 nt, Artificial Sequence
  Description of Artificial Sequence: Synthetic oligonucleotide
uuuaguuuucauggcgaacuu

SEQ ID NO: 29391 - RNA, 21 nt, Artificial Sequence
  Description of Artificial Sequence: Synthetic oligonucleotide
ucuuaguuuucauggcgaauu

SEQ ID NO: 29392 - RNA, 21 nt, Artificial Sequence
  Description of Artificial Sequence: Synthetic oligonucleotide
uccuuaguuuucauggcgauu

SEQ ID NO: 29393 - RNA, 21 nt, Artificial Sequence
  Description of Artificial Sequence: Synthetic oligonucleotide
ugccuuaguuuucauggcguu

SEQ ID NO: 29394 - RNA, 21 nt, Artificial Sequence
  Description of Artificial Sequence: Synthetic oligonucleotide
uagccuuaguuuucauggcuu

SEQ ID NO: 29395 - RNA, 21 nt, Artificial Sequence
  Description of Artificial Sequence: Synthetic oligonucleotide
ucagccuuaguuuucaugguu

SEQ ID NO: 29396 - RNA, 21 nt, Artificial Sequence
  Description of Artificial Sequence: Synthetic oligonucleotide
ugcagccuuaguuuucauguu

SEQ ID NO: 29397 - RNA, 21 nt, Artificial Sequence
  Description of Artificial Sequence: Synthetic oligonucleotide
uggcagccuuaguuuucauuu

SEQ ID NO: 29398 - RNA, 21 nt, Artificial Sequence
  Description of Artificial Sequence: Synthetic oligonucleotide
uaggcagccuuaguuuucauu

SEQ ID NO: 29399 - RNA, 21 nt, Artificial Sequence
  Description of Artificial Sequence: Synthetic oligonucleotide
uaaggcagccuuaguuuucuu

SEQ ID NO: 29400 - RNA, 21 nt, Artificial Sequence
  Description of Artificial Sequence: Synthetic oligonucleotide
uuaaggcagccuuaguuuuuu

SEQ ID NO: 29401 - RNA, 21 nt, Artificial Sequence
  Description of Artificial Sequence: Synthetic oligonucleotide
ucuaaggcagccuuaguuuuu

SEQ ID NO: 29402 - RNA, 21 nt, Artificial Sequence
  Description of Artificial Sequence: Synthetic oligonucleotide
ugcuaaggcagccuuaguuuu

SEQ ID NO: 29403 - RNA, 21 nt, Artificial Sequence
  Description of Artificial Sequence: Synthetic oligonucleotide
uagcuaaggcagccuuaguuu

SEQ ID NO: 29404 - RNA, 21 nt, Artificial Sequence
  Description of Artificial Sequence: Synthetic oligonucleotide
uuagcuaaggcagccuuaguu

SEQ ID NO: 29405 - RNA, 21 nt, Artificial Sequence
  Description of Artificial Sequence: Synthetic oligonucleotide
uauagcuaaggcagccuuauu

SEQ ID NO: 29406 - RNA, 21 nt, Artificial Sequence
  Description of Artificial Sequence: Synthetic oligonucleotide
ugauagcuaaggcagccuuuu

SEQ ID NO: 29407 - RNA, 21 nt, Artificial Sequence
  Description of Artificial Sequence: Synthetic oligonucleotide
uagauagcuaaggcagccuuu

SEQ ID NO: 29408 - RNA, 21 nt, Artificial Sequence
  Description of Artificial Sequence: Synthetic oligonucleotide
ucagauagcuaaggcagccuu

SEQ ID NO: 29409 - RNA, 21 nt, Artificial Sequence
  Description of Artificial Sequence: Synthetic oligonucleotide
uccagauagcuaaggcagcuu

SEQ ID NO: 29410 - RNA, 21 nt, Artificial Sequence
  Description of Artificial Sequence: Synthetic oligonucleotide
uaccagauagcuaaggcaguu

SEQ ID NO: 29411 - RNA, 21 nt, Artificial Sequence
  Description of Artificial Sequence: Synthetic oligonucleotide
ucaccagauagcuaaggcauu

SEQ ID NO: 29412 - RNA, 21 nt, Artificial Sequence
  Description of Artificial Sequence: Synthetic oligonucleotide
ugcaccagauagcuaaggcuu

SEQ ID NO: 29413 - RNA, 21 nt, Artificial Sequence
  Description of Artificial Sequence: Synthetic oligonucleotide
uggcaccagauagcuaagguu

SEQ ID NO: 29414 - RNA, 21 nt, Artificial Sequence
  Description of Artificial Sequence: Synthetic oligonucleotide
ugggcaccagauagcuaaguu

SEQ ID NO: 29415 - RNA, 21 nt, Artificial Sequence
  Description of Artificial Sequence: Synthetic oligonucleotide
uugggcaccagauagcuaauu

SEQ ID NO: 29416 - RNA, 21 nt, Artificial Sequence
  Description of Artificial Sequence: Synthetic oligonucleotide
ucugggcaccagauagcuauu

SEQ ID NO: 29417 - RNA, 21 nt, Artificial Sequence
  Description of Artificial Sequence: Synthetic oligonucleotide
uccugggcaccagauagcuuu

SEQ ID NO: 29418 - RNA, 21 nt, Artificial Sequence
  Description of Artificial Sequence: Synthetic oligonucleotide
ugccugggcaccagauagcuu

SEQ ID NO: 29419 - RNA, 21 nt, Artificial Sequence
  Description of Artificial Sequence: Synthetic oligonucleotide
uagccugggcaccagauaguu

SEQ ID NO: 29420 - RNA, 21 nt, Artificial Sequence
  Description of Artificial Sequence: Synthetic oligonucleotide
uuagccugggcaccagauauu

SEQ ID NO: 29421 - RNA, 21 nt, Artificial Sequence
  Description of Artificial Sequence: Synthetic oligonucleotide
uauagccugggcaccagauuu

SEQ ID NO: 29422 - RNA, 21 nt, Artificial Sequence
  Description of Artificial Sequence: Synthetic oligonucleotide
uaauagccugggcaccagauu

SEQ ID NO: 29423 - RNA, 21 nt, Artificial Sequence
  Description of Artificial Sequence: Synthetic oligonucleotide
ugaauagccugggcaccaguu

SEQ ID NO: 29424 - RNA, 21 nt, Artificial Sequence
  Description of Artificial Sequence: Synthetic oligonucleotide
ucgaauagccugggcaccauu

SEQ ID NO: 29425 - RNA, 21 nt, Artificial Sequence
  Description of Artificial Sequence: Synthetic oligonucleotide
uccgaauagccugggcaccuu

SEQ ID NO: 29426 - RNA, 21 nt, Artificial Sequence
  Description of Artificial Sequence: Synthetic oligonucleotide
uuccgaauagccugggcacuu

SEQ ID NO: 29427 - RNA, 21 nt, Artificial Sequence
  Description of Artificial Sequence: Synthetic oligonucleotide
uuuccgaauagccugggcauu

SEQ ID NO: 29428 - RNA, 21 nt, Artificial Sequence
  Description of Artificial Sequence: Synthetic oligonucleotide
uuuuccgaauagccugggcuu

SEQ ID NO: 29429 - RNA, 21 nt, Artificial Sequence
  Description of Artificial Sequence: Synthetic oligonucleotide
uguuuccgaauagccuggguu

SEQ ID NO: 29430 - RNA, 21 nt, Artificial Sequence
  Description of Artificial Sequence: Synthetic oligonucleotide
uaguuuccgaauagccugguu

SEQ ID NO: 29431 - RNA, 21 nt, Artificial Sequence
  Description of Artificial Sequence: Synthetic oligonucleotide
ugaguuuccgaauagccuguu

SEQ ID NO: 29432 - RNA, 21 nt, Artificial Sequence
  Description of Artificial Sequence: Synthetic oligonucleotide
uugaguuuccgaauagccuuu

SEQ ID NO: 29433 - RNA, 21 nt, Artificial Sequence
  Description of Artificial Sequence: Synthetic oligonucleotide
ucugaguuuccgaauagccuu

SEQ ID NO: 29434 - RNA, 21 nt, Artificial Sequence
  Description of Artificial Sequence: Synthetic oligonucleotide
uucugaguuuccgaauagcuu

SEQ ID NO: 29435 - RNA, 21 nt, Artificial Sequence
  Description of Artificial Sequence: Synthetic oligonucleotide
uaucugaguuuccgaauaguu

SEQ ID NO: 29436 - RNA, 21 nt, Artificial Sequence
  Description of Artificial Sequence: Synthetic oligonucleotide
uuaucugaguuuccgaauauu

SEQ ID NO: 29437 - RNA, 21 nt, Artificial Sequence
  Description of Artificial Sequence: Synthetic oligonucleotide
uuuaucugaguuuccgaauuu

SEQ ID NO: 29438 - RNA, 21 nt, Artificial Sequence
  Description of Artificial Sequence: Synthetic oligonucleotide
uuuuaucugaguuuccgaauu

SEQ ID NO: 29439 - RNA, 21 nt, Artificial Sequence
  Description of Artificial Sequence: Synthetic oligonucleotide
uauuuaucugaguuuccgauu

SEQ ID NO: 29440 - RNA, 21 nt, Artificial Sequence
  Description of Artificial Sequence: Synthetic oligonucleotide
ucauuuaucugaguuuccguu

SEQ ID NO: 29441 - RNA, 21 nt, Artificial Sequence
  Description of Artificial Sequence: Synthetic oligonucleotide
ugcauuuaucugaguuuccuu

SEQ ID NO: 29442 - RNA, 21 nt, Artificial Sequence
  Description of Artificial Sequence: Synthetic oligonucleotide
uagcauuuaucugaguuucuu

SEQ ID NO: 29443 - RNA, 21 nt, Artificial Sequence
  Description of Artificial Sequence: Synthetic oligonucleotide
uuagcauuuaucugaguuuuu

SEQ ID NO: 29444 - RNA, 21 nt, Artificial Sequence
  Description of Artificial Sequence: Synthetic oligonucleotide
uguagcauuuaucugaguuuu

SEQ ID NO: 29445 - RNA, 21 nt, Artificial Sequence
  Description of Artificial Sequence: Synthetic oligonucleotide
uaguagcauuuaucugaguuu

SEQ ID NO: 29446 - RNA, 21 nt, Artificial Sequence
  Description of Artificial Sequence: Synthetic oligonucleotide
ugaguagcauuuaucugaguu

SEQ ID NO: 29447 - RNA, 21 nt, Artificial Sequence
  Description of Artificial Sequence: Synthetic oligonucleotide
uugaguagcauuuaucugauu

SEQ ID NO: 29448 - RNA, 21 nt, Artificial Sequence
  Description of Artificial Sequence: Synthetic oligonucleotide
ucugaguagcauuuaucuguu

SEQ ID NO: 29449 - RNA, 21 nt, Artificial Sequence
  Description of Artificial Sequence: Synthetic oligonucleotide
uccugaguagcauuuaucuuu

SEQ ID NO: 29450 - RNA, 21 nt, Artificial Sequence
  Description of Artificial Sequence: Synthetic oligonucleotide
ugccugaguagcauuuaucuu

SEQ ID NO: 29451 - RNA, 21 nt, Artificial Sequence
  Description of Artificial Sequence: Synthetic oligonucleotide
uugccugaguagcauuuauuu

SEQ ID NO: 29452 - RNA, 21 nt, Artificial Sequence
  Description of Artificial Sequence: Synthetic oligonucleotide
uuugccugaguagcauuuauu

SEQ ID NO: 29453 - RNA, 21 nt, Artificial Sequence
  Description of Artificial Sequence: Synthetic oligonucleotide
uauugccugaguagcauuuuu

SEQ ID NO: 29454 - RNA, 21 nt, Artificial Sequence
  Description of Artificial Sequence: Synthetic oligonucleotide
ucauugccugaguagcauuuu

SEQ ID NO: 29455 - RNA, 21 nt, Artificial Sequence
  Description of Artificial Sequence: Synthetic oligonucleotide
uucauugccugaguagcauuu

SEQ ID NO: 29456 - RNA, 21 nt, Artificial Sequence
  Description of Artificial Sequence: Synthetic oligonucleotide
uuucauugccugaguagcauu

SEQ ID NO: 29457 - RNA, 21 nt, Artificial Sequence
  Description of Artificial Sequence: Synthetic oligonucleotide
ucuucauugccugaguagcuu

SEQ ID NO: 29458 - RNA, 21 nt, Artificial Sequence
  Description of Artificial Sequence: Synthetic oligonucleotide
uucuucauugccugaguaguu

SEQ ID NO: 29459 - RNA, 21 nt, Artificial Sequence
  Description of Artificial Sequence: Synthetic oligonucleotide
uuucuucauugccugaguauu

SEQ ID NO: 29460 - RNA, 21 nt, Artificial Sequence
  Description of Artificial Sequence: Synthetic oligonucleotide
ucuucuucauugccugaguuu

SEQ ID NO: 29461 - RNA, 21 nt, Artificial Sequence
  Description of Artificial Sequence: Synthetic oligonucleotide
uucuucuucauugccugaguu

SEQ ID NO: 29462 - RNA, 21 nt, Artificial Sequence
  Description of Artificial Sequence: Synthetic oligonucleotide
ucucuucuucauugccugauu

SEQ ID NO: 29463 - RNA, 21 nt, Artificial Sequence
  Description of Artificial Sequence: Synthetic oligonucleotide
uccucuucuucauugccuguu

SEQ ID NO: 29464 - RNA, 21 nt, Artificial Sequence
  Description of Artificial Sequence: Synthetic oligonucleotide
uuccucuucuucauugccuuu

SEQ ID NO: 29465 - RNA, 21 nt, Artificial Sequence
  Description of Artificial Sequence: Synthetic oligonucleotide
ucuccucuucuucauugccuu

SEQ ID NO: 29466 - RNA, 21 nt, Artificial Sequence
  Description of Artificial Sequence: Synthetic oligonucleotide
uucuccucuucuucauugcuu

SEQ ID NO: 29467 - RNA, 21 nt, Artificial Sequence
  Description of Artificial Sequence: Synthetic oligonucleotide
uuucuccucuucuucauuguu

SEQ ID NO: 29468 - RNA, 21 nt, Artificial Sequence
  Description of Artificial Sequence: Synthetic oligonucleotide
uuuucuccucuucuucauuuu

SEQ ID NO: 29469 - RNA, 21 nt, Artificial Sequence
  Description of Artificial Sequence: Synthetic oligonucleotide
uuuuucuccucuucuucauuu

SEQ ID NO: 29470 - RNA, 21 nt, Artificial Sequence
  Description of Artificial Sequence: Synthetic oligonucleotide
uuuuuucuccucuucuucauu

SEQ ID NO: 29471 - RNA, 21 nt, Artificial Sequence
  Description of Artificial Sequence: Synthetic oligonucleotide
ucuuuuucuccucuucuucuu

SEQ ID NO: 29472 - RNA, 21 nt, Artificial Sequence
  Description of Artificial Sequence: Synthetic oligonucleotide
uccuuuuucuccucuucuuuu

SEQ ID NO: 29473 - RNA, 21 nt, Artificial Sequence
  Description of Artificial Sequence: Synthetic oligonucleotide
uuccuuuuucuccucuucuuu

SEQ ID NO: 29474 - RNA, 21 nt, Artificial Sequence
  Description of Artificial Sequence: Synthetic oligonucleotide
uuuccuuuuucuccucuucuu

SEQ ID NO: 29475 - RNA, 21 nt, Artificial Sequence
  Description of Artificial Sequence: Synthetic oligonucleotide
uuuuccuuuuucuccucuuuu

SEQ ID NO: 29476 - RNA, 21 nt, Artificial Sequence
  Description of Artificial Sequence: Synthetic oligonucleotide
ucuuuccuuuuucuccucuuu

SEQ ID NO: 29477 - RNA, 21 nt, Artificial Sequence
  Description of Artificial Sequence: Synthetic oligonucleotide
uacuuuccuuuuucuccucuu

SEQ ID NO: 29478 - RNA, 21 nt, Artificial Sequence
  Description of Artificial Sequence: Synthetic oligonucleotide
ugacuuuccuuuuucuccuuu

SEQ ID NO: 29479 - RNA, 21 nt, Artificial Sequence
  Description of Artificial Sequence: Synthetic oligonucleotide
uugacuuuccuuuuucuccuu

SEQ ID NO: 29480 - RNA, 21 nt, Artificial Sequence
  Description of Artificial Sequence: Synthetic oligonucleotide
ugugacuuuccuuuuucucuu

SEQ ID NO: 29481 - RNA, 21 nt, Artificial Sequence
  Description of Artificial Sequence: Synthetic oligonucleotide
uugugacuuuccuuuuucuuu

SEQ ID NO: 29482 - RNA, 21 nt, Artificial Sequence
  Description of Artificial Sequence: Synthetic oligonucleotide
uuugugacuuuccuuuuucuu

SEQ ID NO: 29483 - RNA, 21 nt, Artificial Sequence
  Description of Artificial Sequence: Synthetic oligonucleotide
uguugugacuuuccuuuuuuu

SEQ ID NO: 29484 - RNA, 21 nt, Artificial Sequence
  Description of Artificial Sequence: Synthetic oligonucleotide
ugguugugacuuuccuuuuuu

SEQ ID NO: 29485 - RNA, 21 nt, Artificial Sequence
  Description of Artificial Sequence: Synthetic oligonucleotide
uugguugugacuuuccuuuuu

SEQ ID NO: 29486 - RNA, 21 nt, Artificial Sequence
  Description of Artificial Sequence: Synthetic oligonucleotide
uuugguugugacuuuccuuuu

SEQ ID NO: 29487 - RNA, 21 nt, Artificial Sequence
  Description of Artificial Sequence: Synthetic oligonucleotide
uauugguugugacuuuccuuu

SEQ ID NO: 29488 - RNA, 21 nt, Artificial Sequence
  Description of Artificial Sequence: Synthetic oligonucleotide
uuauugguugugacuuuccuu

SEQ ID NO: 29489 - RNA, 21 nt, Artificial Sequence
  Description of Artificial Sequence: Synthetic oligonucleotide
uuuauugguugugacuuucuu

SEQ ID NO: 29490 - RNA, 21 nt, Artificial Sequence
  Description of Artificial Sequence: Synthetic oligonucleotide
uuuuauugguugugacuuuuu

SEQ ID NO: 29491 - RNA, 21 nt, Artificial Sequence
  Description of Artificial Sequence: Synthetic oligonucleotide
uauuuauugguugugacuuuu

SEQ ID NO: 29492 - RNA, 21 nt, Artificial Sequence
  Description of Artificial Sequence: Synthetic oligonucleotide
ucauuuauugguugugacuuu

SEQ ID NO: 29493 - RNA, 21 nt, Artificial Sequence
  Description of Artificial Sequence: Synthetic oligonucleotide
uacauuuauugguugugacuu

SEQ ID NO: 29494 - RNA, 21 nt, Artificial Sequence
  Description of Artificial Sequence: Synthetic oligonucleotide
ugacauuuauugguugugauu

SEQ ID NO: 29495 - RNA, 21 nt, Artificial Sequence
  Description of Artificial Sequence: Synthetic oligonucleotide
uagacauuuauugguuguguu

SEQ ID NO: 29496 - RNA, 21 nt, Artificial Sequence
  Description of Artificial Sequence: Synthetic oligonucleotide
ucagacauuuauugguuguuu

SEQ ID NO: 29497 - RNA, 21 nt, Artificial Sequence
  Description of Artificial Sequence: Synthetic oligonucleotide
uccagacauuuauugguuguu

SEQ ID NO: 29498 - RNA, 21 nt, Artificial Sequence
  Description of Artificial Sequence: Synthetic oligonucleotide
uuccagacauuuauugguuuu

SEQ ID NO: 29499 - RNA, 21 nt, Artificial Sequence
  Description of Artificial Sequence: Synthetic oligonucleotide
uuuccagacauuuauugguuu

SEQ ID NO: 29500 - RNA, 21 nt, Artificial Sequence
  Description of Artificial Sequence: Synthetic oligonucleotide
uguuccagacauuuauugguu

SEQ ID NO: 29501 - RNA, 21 nt, Artificial Sequence
  Description of Artificial Sequence: Synthetic oligonucleotide
uuguuccagacauuuauuguu

SEQ ID NO: 29502 - RNA, 21 nt, Artificial Sequence
  Description of Artificial Sequence: Synthetic oligonucleotide
uuuguuccagacauuuauuuu

SEQ ID NO: 29503 - RNA, 21 nt, Artificial Sequence
  Description of Artificial Sequence: Synthetic oligonucleotide
ucuuguuccagacauuuauuu

SEQ ID NO: 29504 - RNA, 21 nt, Artificial Sequence
  Description of Artificial Sequence: Synthetic oligonucleotide
uacuuguuccagacauuuauu

SEQ ID NO: 29505 - RNA, 21 nt, Artificial Sequence
  Description of Artificial Sequence: Synthetic oligonucleotide
ucacuuguuccagacauuuuu

SEQ ID NO: 29506 - RNA, 21 nt, Artificial Sequence
  Description of Artificial Sequence: Synthetic oligonucleotide
uacacuuguuccagacauuuu

SEQ ID NO: 29507 - RNA, 21 nt, Artificial Sequence
  Description of Artificial Sequence: Synthetic oligonucleotide
ugacacuuguuccagacauuu

SEQ ID NO: 29508 - RNA, 21 nt, Artificial Sequence
  Description of Artificial Sequence: Synthetic oligonucleotide
uugacacuuguuccagacauu

SEQ ID NO: 29509 - RNA, 21 nt, Artificial Sequence
  Description of Artificial Sequence: Synthetic oligonucleotide
ugugacacuuguuccagacuu

SEQ ID NO: 29510 - RNA, 21 nt, Artificial Sequence
  Description of Artificial Sequence: Synthetic oligonucleotide
uugugacacuuguuccagauu

SEQ ID NO: 29511 - RNA, 21 nt, Artificial Sequence
  Description of Artificial Sequence: Synthetic oligonucleotide
uuugugacacuuguuccaguu

SEQ ID NO: 29512 - RNA, 21 nt, Artificial Sequence
  Description of Artificial Sequence: Synthetic oligonucleotide
uauugugacacuuguuccauu

SEQ ID NO: 29513 - RNA, 21 nt, Artificial Sequence
  Description of Artificial Sequence: Synthetic oligonucleotide
uaauugugacacuuguuccuu

SEQ ID NO: 29514 - RNA, 21 nt, Artificial Sequence
  Description of Artificial Sequence: Synthetic oligonucleotide
uuaauugugacacuuguucuu

SEQ ID NO: 29515 - RNA, 21 nt, Artificial Sequence
  Description of Artificial Sequence: Synthetic oligonucleotide
uguaauugugacacuuguuuu

SEQ ID NO: 29516 - RNA, 21 nt, Artificial Sequence
  Description of Artificial Sequence: Synthetic oligonucleotide
uuguaauugugacacuuguuu

SEQ ID NO: 29517 - RNA, 21 nt, Artificial Sequence
  Description of Artificial Sequence: Synthetic oligonucleotide
uuuguaauugugacacuuguu

SEQ ID NO: 29518 - RNA, 21 nt, Artificial Sequence
  Description of Artificial Sequence: Synthetic oligonucleotide
ucuuguaauugugacacuuuu

SEQ ID NO: 29519 - RNA, 21 nt, Artificial Sequence
  Description of Artificial Sequence: Synthetic oligonucleotide
uccuuguaauugugacacuuu

SEQ ID NO: 29520 - RNA, 21 nt, Artificial Sequence
  Description of Artificial Sequence: Synthetic oligonucleotide
uuccuuguaauugugacacuu

SEQ ID NO: 29521 - RNA, 21 nt, Artificial Sequence
  Description of Artificial Sequence: Synthetic oligonucleotide
uauccuuguaauugugacauu

SEQ ID NO: 29522 - RNA, 21 nt, Artificial Sequence
  Description of Artificial Sequence: Synthetic oligonucleotide
uaauccuuguaauugugacuu

SEQ ID NO: 29523 - RNA, 21 nt, Artificial Sequence
  Description of Artificial Sequence: Synthetic oligonucleotide
ucaauccuuguaauugugauu

SEQ ID NO: 29524 - RNA, 21 nt, Artificial Sequence
  Description of Artificial Sequence: Synthetic oligonucleotide
uacaauccuuguaauuguguu

SEQ ID NO: 29525 - RNA, 21 nt, Artificial Sequence
  Description of Artificial Sequence: Synthetic oligonucleotide
ucacaauccuuguaauuguuu

SEQ ID NO: 29526 - RNA, 21 nt, Artificial Sequence
  Description of Artificial Sequence: Synthetic oligonucleotide
uccacaauccuuguaauuguu

SEQ ID NO: 29527 - RNA, 21 nt, Artificial Sequence
  Description of Artificial Sequence: Synthetic oligonucleotide
ugccacaauccuuguaauuuu

SEQ ID NO: 29528 - RNA, 21 nt, Artificial Sequence
  Description of Artificial Sequence: Synthetic oligonucleotide
ucgccacaauccuuguaauuu

SEQ ID NO: 29529 - RNA, 21 nt, Artificial Sequence
  Description of Artificial Sequence: Synthetic oligonucleotide
uacgccacaauccuuguaauu

SEQ ID NO: 29530 - RNA, 21 nt, Artificial Sequence
  Description of Artificial Sequence: Synthetic oligonucleotide
ugacgccacaauccuuguauu

SEQ ID NO: 29531 - RNA, 21 nt, Artificial Sequence
  Description of Artificial Sequence: Synthetic oligonucleotide
ucgacgccacaauccuuguuu

SEQ ID NO: 29532 - RNA, 21 nt, Artificial Sequence
  Description of Artificial Sequence: Synthetic oligonucleotide
ugcgacgccacaauccuuguu

SEQ ID NO: 29533 - RNA, 21 nt, Artificial Sequence
  Description of Artificial Sequence: Synthetic oligonucleotide
uagcgacgccacaauccuuuu

SEQ ID NO: 29534 - RNA, 21 nt, Artificial Sequence
  Description of Artificial Sequence: Synthetic oligonucleotide
uaagcgacgccacaauccuuu

SEQ ID NO: 29535 - RNA, 21 nt, Artificial Sequence
  Description of Artificial Sequence: Synthetic oligonucleotide
ugaagcgacgccacaauccuu

SEQ ID NO: 29536 - RNA, 21 nt, Artificial Sequence
  Description of Artificial Sequence: Synthetic oligonucleotide
uugaagcgacgccacaaucuu

SEQ ID NO: 29537 - RNA, 21 nt, Artificial Sequence
  Description of Artificial Sequence: Synthetic oligonucleotide
uuugaagcgacgccacaauuu

SEQ ID NO: 29538 - RNA, 21 nt, Artificial Sequence
  Description of Artificial Sequence: Synthetic oligonucleotide
uauugaagcgacgccacaauu

SEQ ID NO: 29539 - RNA, 21 nt, Artificial Sequence
  Description of Artificial Sequence: Synthetic oligonucleotide
ugauugaagcgacgccacauu

SEQ ID NO: 29540 - RNA, 21 nt, Artificial Sequence
  Description of Artificial Sequence: Synthetic oligonucleotide
ucgauugaagcgacgccacuu

SEQ ID NO: 29541 - RNA, 21 nt, Artificial Sequence
  Description of Artificial Sequence: Synthetic oligonucleotide
uucgauugaagcgacgccauu

SEQ ID NO: 29542 - RNA, 21 nt, Artificial Sequence
  Description of Artificial Sequence: Synthetic oligonucleotide
ugucgauugaagcgacgccuu

SEQ ID NO: 29543 - RNA, 21 nt, Artificial Sequence
  Description of Artificial Sequence: Synthetic oligonucleotide
uggucgauugaagcgacgcuu

SEQ ID NO: 29544 - RNA, 21 nt, Artificial Sequence
  Description of Artificial Sequence: Synthetic oligonucleotide
uaggucgauugaagcgacguu

SEQ ID NO: 29545 - RNA, 21 nt, Artificial Sequence
  Description of Artificial Sequence: Synthetic oligonucleotide
uaaggucgauugaagcgacuu

SEQ ID NO: 29546 - RNA, 21 nt, Artificial Sequence
  Description of Artificial Sequence: Synthetic oligonucleotide
uaaaggucgauugaagcgauu

SEQ ID NO: 29547 - RNA, 21 nt, Artificial Sequence
  Description of Artificial Sequence: Synthetic oligonucleotide
uuaaaggucgauugaagcguu

SEQ ID NO: 29548 - RNA, 21 nt, Artificial Sequence
  Description of Artificial Sequence: Synthetic oligonucleotide
uguaaaggucgauugaagcuu

SEQ ID NO: 29549 - RNA, 21 nt, Artificial Sequence
  Description of Artificial Sequence: Synthetic oligonucleotide
uaguaaaggucgauugaaguu

SEQ ID NO: 29550 - RNA, 21 nt, Artificial Sequence
  Description of Artificial Sequence: Synthetic oligonucleotide
ucaguaaaggucgauugaauu

SEQ ID NO: 29551 - RNA, 21 nt, Artificial Sequence
  Description of Artificial Sequence: Synthetic oligonucleotide
uucaguaaaggucgauugauu

SEQ ID NO: 29552 - RNA, 21 nt, Artificial Sequence
  Description of Artificial Sequence: Synthetic oligonucleotide
uuucaguaaaggucgauuguu

SEQ ID NO: 29553 - RNA, 21 nt, Artificial Sequence
  Description of Artificial Sequence: Synthetic oligonucleotide
uuuucaguaaaggucgauuuu

SEQ ID NO: 29554 - RNA, 21 nt, Artificial Sequence
  Description of Artificial Sequence: Synthetic oligonucleotide
uguuucaguaaaggucgauuu

SEQ ID NO: 29555 - RNA, 21 nt, Artificial Sequence
  Description of Artificial Sequence: Synthetic oligonucleotide
uuguuucaguaaaggucgauu

SEQ ID NO: 29556 - RNA, 21 nt, Artificial Sequence
  Description of Artificial Sequence: Synthetic oligonucleotide
uuuguuucaguaaaggucguu

SEQ ID NO: 29557 - RNA, 21 nt, Artificial Sequence
  Description of Artificial Sequence: Synthetic oligonucleotide
uguuguuucaguaaaggucuu

SEQ ID NO: 29558 - RNA, 21 nt, Artificial Sequence
  Description of Artificial Sequence: Synthetic oligonucleotide
uuguuguuucaguaaagguuu

SEQ ID NO: 29559 - RNA, 21 nt, Artificial Sequence
  Description of Artificial Sequence: Synthetic oligonucleotide
ucuguuguuucaguaaagguu

SEQ ID NO: 29560 - RNA, 21 nt, Artificial Sequence
  Description of Artificial Sequence: Synthetic oligonucleotide
uacuguuguuucaguaaaguu

SEQ ID NO: 29561 - RNA, 21 nt, Artificial Sequence
  Description of Artificial Sequence: Synthetic oligonucleotide
uuacuguuguuucaguaaauu

SEQ ID NO: 29562 - RNA, 21 nt, Artificial Sequence
  Description of Artificial Sequence: Synthetic oligonucleotide
uuuacuguuguuucaguaauu

SEQ ID NO: 29563 - RNA, 21 nt, Artificial Sequence
  Description of Artificial Sequence: Synthetic oligonucleotide
uuuuacuguuguuucaguauu

SEQ ID NO: 29564 - RNA, 21 nt, Artificial Sequence
  Description of Artificial Sequence: Synthetic oligonucleotide
uguuuacuguuguuucaguuu

SEQ ID NO: 29565 - RNA, 21 nt, Artificial Sequence
  Description of Artificial Sequence: Synthetic oligonucleotide
ugguuuacuguuguuucaguu

SEQ ID NO: 29566 - RNA, 21 nt, Artificial Sequence
  Description of Artificial Sequence: Synthetic oligonucleotide
uugguuuacuguuguuucauu

SEQ ID NO: 29567 - RNA, 21 nt, Artificial Sequence
  Description of Artificial Sequence: Synthetic oligonucleotide
uaugguuuacuguuguuucuu

SEQ ID NO: 29568 - RNA, 21 nt, Artificial Sequence
  Description of Artificial Sequence: Synthetic oligonucleotide
ugaugguuuacuguuguuuuu

SEQ ID NO: 29569 - RNA, 21 nt, Artificial Sequence
  Description of Artificial Sequence: Synthetic oligonucleotide
uagaugguuuacuguuguuuu

SEQ ID NO: 29570 - RNA, 21 nt, Artificial Sequence
  Description of Artificial Sequence: Synthetic oligonucleotide
uaagaugguuuacuguuguuu

SEQ ID NO: 29571 - RNA, 21 nt, Artificial Sequence
  Description of Artificial Sequence: Synthetic oligonucleotide
uaaagaugguuuacuguuguu

SEQ ID NO: 29572 - RNA, 21 nt, Artificial Sequence
  Description of Artificial Sequence: Synthetic oligonucleotide
uuaaagaugguuuacuguuuu

SEQ ID NO: 29573 - RNA, 21 nt, Artificial Sequence
  Description of Artificial Sequence: Synthetic oligonucleotide
uauaaagaugguuuacuguuu

SEQ ID NO: 29574 - RNA, 21 nt, Artificial Sequence
  Description of Artificial Sequence: Synthetic oligonucleotide
uaauaaagaugguuuacuguu

SEQ ID NO: 29575 - RNA, 21 nt, Artificial Sequence
  Description of Artificial Sequence: Synthetic oligonucleotide
uuaauaaagaugguuuacuuu

SEQ ID NO: 29576 - RNA, 21 nt, Artificial Sequence
  Description of Artificial Sequence: Synthetic oligonucleotide
uauaauaaagaugguuuacuu

SEQ ID NO: 29577 - RNA, 21 nt, Artificial Sequence
  Description of Artificial Sequence: Synthetic oligonucleotide
ucauaauaaagaugguuuauu

SEQ ID NO: 29578 - RNA, 21 nt, Artificial Sequence
  Description of Artificial Sequence: Synthetic oligonucleotide
uccauaauaaagaugguuuuu

SEQ ID NO: 29579 - RNA, 21 nt, Artificial Sequence
  Description of Artificial Sequence: Synthetic oligonucleotide
uaccauaauaaagaugguuuu

SEQ ID NO: 29580 - RNA, 21 nt, Artificial Sequence
  Description of Artificial Sequence: Synthetic oligonucleotide
ugaccauaauaaagaugguuu

SEQ ID NO: 29581 - RNA, 21 nt, Artificial Sequence
  Description of Artificial Sequence: Synthetic oligonucleotide
uugaccauaauaaagaugguu

SEQ ID NO: 29582 - RNA, 21 nt, Artificial Sequence
  Description of Artificial Sequence: Synthetic oligonucleotide
uaugaccauaauaaagauguu

SEQ ID NO: 29583 - RNA, 21 nt, Artificial Sequence
  Description of Artificial Sequence: Synthetic oligonucleotide
uuaugaccauaauaaagauuu

SEQ ID NO: 29584 - RNA, 21 nt, Artificial Sequence
  Description of Artificial Sequence: Synthetic oligonucleotide
uauaugaccauaauaaagauu

SEQ ID NO: 29585 - RNA, 21 nt, Artificial Sequence
  Description of Artificial Sequence: Synthetic oligonucleotide
uaauaugaccauaauaaaguu

SEQ ID NO: 29586 - RNA, 21 nt, Artificial Sequence
  Description of Artificial Sequence: Synthetic oligonucleotide
uaaauaugaccauaauaaauu

SEQ ID NO: 29587 - RNA, 21 nt, Artificial Sequence
  Description of Artificial Sequence: Synthetic oligonucleotide
ugaaauaugaccauaauaauu

SEQ ID NO: 29588 - RNA, 21 nt, Artificial Sequence
  Description of Artificial Sequence: Synthetic oligonucleotide
uugaaauaugaccauaauauu

SEQ ID NO: 29589 - RNA, 21 nt, Artificial Sequence
  Description of Artificial Sequence: Synthetic oligonucleotide
ugugaaauaugaccauaauuu

SEQ ID NO: 29590 - RNA, 21 nt, Artificial Sequence
  Description of Artificial Sequence: Synthetic oligonucleotide
uugugaaauaugaccauaauu

SEQ ID NO: 29591 - RNA, 21 nt, Artificial Sequence
  Description of Artificial Sequence: Synthetic oligonucleotide
ucugugaaauaugaccauauu

SEQ ID NO: 29592 - RNA, 21 nt, Artificial Sequence
  Description of Artificial Sequence: Synthetic oligonucleotide
ugcugugaaauaugaccauuu

SEQ ID NO: 29593 - RNA, 21 nt, Artificial Sequence
  Description of Artificial Sequence: Synthetic oligonucleotide
uugcugugaaauaugaccauu

SEQ ID NO: 29594 - RNA, 21 nt, Artificial Sequence
  Description of Artificial Sequence: Synthetic oligonucleotide
ugugcugugaaauaugaccuu

SEQ ID NO: 29595 - RNA, 21 nt, Artificial Sequence
  Description of Artificial Sequence: Synthetic oligonucleotide
uggugcugugaaauaugacuu

SEQ ID NO: 29596 - RNA, 21 nt, Artificial Sequence
  Description of Artificial Sequence: Synthetic oligonucleotide
uuggugcugugaaauaugauu

SEQ ID NO: 29597 - RNA, 21 nt, Artificial Sequence
  Description of Artificial Sequence: Synthetic oligonucleotide
uuuggugcugugaaauauguu

SEQ ID NO: 29598 - RNA, 21 nt, Artificial Sequence
  Description of Artificial Sequence: Synthetic oligonucleotide
uuuuggugcugugaaauauuu

SEQ ID NO: 29599 - RNA, 21 nt, Artificial Sequence
  Description of Artificial Sequence: Synthetic oligonucleotide
uuuuuggugcugugaaauauu

SEQ ID NO: 29600 - RNA, 21 nt, Artificial Sequence
  Description of Artificial Sequence: Synthetic oligonucleotide
uauuuuggugcugugaaauuu

SEQ ID NO: 29601 - RNA, 21 nt, Artificial Sequence
  Description of Artificial Sequence: Synthetic oligonucleotide
uuauuuuggugcugugaaauu

SEQ ID NO: 29602 - RNA, 21 nt, Artificial Sequence
  Description of Artificial Sequence: Synthetic oligonucleotide
uuuauuuuggugcugugaauu

SEQ ID NO: 29603 - RNA, 21 nt, Artificial Sequence
  Description of Artificial Sequence: Synthetic oligonucleotide
uuuuauuuuggugcugugauu

SEQ ID NO: 29604 - RNA, 21 nt, Artificial Sequence
  Description of Artificial Sequence: Synthetic oligonucleotide
uauuuauuuuggugcuguguu

SEQ ID NO: 29605 - RNA, 21 nt, Artificial Sequence
  Description of Artificial Sequence: Synthetic oligonucleotide
ugauuuauuuuggugcuguuu

SEQ ID NO: 29606 - RNA, 21 nt, Artificial Sequence
  Description of Artificial Sequence: Synthetic oligonucleotide
uugauuuauuuuggugcuguu

SEQ ID NO: 29607 - RNA, 21 nt, Artificial Sequence
  Description of Artificial Sequence: Synthetic oligonucleotide
uaugauuuauuuuggugcuuu

SEQ ID NO: 29608 - RNA, 21 nt, Artificial Sequence
  Description of Artificial Sequence: Synthetic oligonucleotide
ugaugauuuauuuuggugcuu

SEQ ID NO: 29609 - RNA, 21 nt, Artificial Sequence
  Description of Artificial Sequence: Synthetic oligonucleotide
uagaugauuuauuuugguguu

SEQ ID NO: 29610 - RNA, 21 nt, Artificial Sequence
  Description of Artificial Sequence: Synthetic oligonucleotide
uaagaugauuuauuuugguuu

SEQ ID NO: 29611 - RNA, 21 nt, Artificial Sequence
  Description of Artificial Sequence: Synthetic oligonucleotide
uaaagaugauuuauuuugguu

SEQ ID NO: 29612 - RNA, 21 nt, Artificial Sequence
  Description of Artificial Sequence: Synthetic oligonucleotide
uuaaagaugauuuauuuuguu

SEQ ID NO: 29613 - RNA, 21 nt, Artificial Sequence
  Description of Artificial Sequence: Synthetic oligonucleotide
uauaaagaugauuuauuuuuu

SEQ ID NO: 29614 - RNA, 21 nt, Artificial Sequence
  Description of Artificial Sequence: Synthetic oligonucleotide
uaauaaagaugauuuauuuuu

SEQ ID NO: 29615 - RNA, 21 nt, Artificial Sequence
  Description of Artificial Sequence: Synthetic oligonucleotide
uuaauaaagaugauuuauuuu

SEQ ID NO: 29616 - RNA, 21 nt, Artificial Sequence
  Description of Artificial Sequence: Synthetic oligonucleotide
uuuaauaaagaugauuuauuu

SEQ ID NO: 29617 - RNA, 21 nt, Artificial Sequence
  Description of Artificial Sequence: Synthetic oligonucleotide
ucuuaauaaagaugauuuauu

SEQ ID NO: 29618 - RNA, 21 nt, Artificial Sequence
  Description of Artificial Sequence: Synthetic oligonucleotide
uacuuaauaaagaugauuuuu

SEQ ID NO: 29619 - RNA, 21 nt, Artificial Sequence
  Description of Artificial Sequence: Synthetic oligonucleotide
uuacuuaauaaagaugauuuu

SEQ ID NO: 29620 - RNA, 21 nt, Artificial Sequence
  Description of Artificial Sequence: Synthetic oligonucleotide
ucuacuuaauaaagaugauuu

SEQ ID NO: 29621 - RNA, 21 nt, Artificial Sequence
  Description of Artificial Sequence: Synthetic oligonucleotide
uucuacuuaauaaagaugauu

SEQ ID NO: 29622 - RNA, 21 nt, Artificial Sequence
  Description of Artificial Sequence: Synthetic oligonucleotide
uaucuacuuaauaaagauguu

SEQ ID NO: 29623 - RNA, 21 nt, Artificial Sequence
  Description of Artificial Sequence: Synthetic oligonucleotide
ucaucuacuuaauaaagauuu

SEQ ID NO: 29624 - RNA, 21 nt, Artificial Sequence
  Description of Artificial Sequence: Synthetic oligonucleotide
uucaucuacuuaauaaagauu

SEQ ID NO: 29625 - RNA, 21 nt, Artificial Sequence
  Description of Artificial Sequence: Synthetic oligonucleotide
uuucaucuacuuaauaaaguu

SEQ ID NO: 29626 - RNA, 21 nt, Artificial Sequence
  Description of Artificial Sequence: Synthetic oligonucleotide
uuuucaucuacuuaauaaauu

SEQ ID NO: 29627 - RNA, 21 nt, Artificial Sequence
  Description of Artificial Sequence: Synthetic oligonucleotide
uguuucaucuacuuaauaauu

SEQ ID NO: 29628 - RNA, 21 nt, Artificial Sequence
  Description of Artificial Sequence: Synthetic oligonucleotide
uuguuucaucuacuuaauauu

SEQ ID NO: 29629 - RNA, 21 nt, Artificial Sequence
  Description of Artificial Sequence: Synthetic oligonucleotide
uauguuucaucuacuuaauuu

SEQ ID NO: 29630 - RNA, 21 nt, Artificial Sequence
  Description of Artificial Sequence: Synthetic oligonucleotide
uaauguuucaucuacuuaauu

SEQ ID NO: 29631 - RNA, 21 nt, Artificial Sequence
  Description of Artificial Sequence: Synthetic oligonucleotide
uuaauguuucaucuacuuauu

SEQ ID NO: 29632 - RNA, 21 nt, Artificial Sequence
  Description of Artificial Sequence: Synthetic oligonucleotide
uuuaauguuucaucuacuuuu

SEQ ID NO: 29633 - RNA, 21 nt, Artificial Sequence
  Description of Artificial Sequence: Synthetic oligonucleotide
uguuaauguuucaucuacuuu

SEQ ID NO: 29634 - RNA, 21 nt, Artificial Sequence
  Description of Artificial Sequence: Synthetic oligonucleotide
uaguuaauguuucaucuacuu

SEQ ID NO: 29635 - RNA, 21 nt, Artificial Sequence
  Description of Artificial Sequence: Synthetic oligonucleotide
ugaguuaauguuucaucuauu

SEQ ID NO: 29636 - RNA, 21 nt, Artificial Sequence
  Description of Artificial Sequence: Synthetic oligonucleotide
uagaguuaauguuucaucuuu

SEQ ID NO: 29637 - RNA, 21 nt, Artificial Sequence
  Description of Artificial Sequence: Synthetic oligonucleotide
uuagaguuaauguuucaucuu

SEQ ID NO: 29638 - RNA, 21 nt, Artificial Sequence
  Description of Artificial Sequence: Synthetic oligonucleotide
uuuagaguuaauguuucauuu

SEQ ID NO: 29639 - RNA, 21 nt, Artificial Sequence
  Description of Artificial Sequence: Synthetic oligonucleotide
uguuagaguuaauguuucauu

SEQ ID NO: 29640 - RNA, 21 nt, Artificial Sequence
  Description of Artificial Sequence: Synthetic oligonucleotide
uaguuagaguuaauguuucuu

SEQ ID NO: 29641 - RNA, 21 nt, Artificial Sequence
  Description of Artificial Sequence: Synthetic oligonucleotide
ucaguuagaguuaauguuuuu

SEQ ID NO: 29642 - RNA, 21 nt, Artificial Sequence
  Description of Artificial Sequence: Synthetic oligonucleotide
uacaguuagaguuaauguuuu

SEQ ID NO: 29643 - RNA, 21 nt, Artificial Sequence
  Description of Artificial Sequence: Synthetic oligonucleotide
ucacaguuagaguuaauguuu

SEQ ID NO: 29644 - RNA, 21 nt, Artificial Sequence
  Description of Artificial Sequence: Synthetic oligonucleotide
uucacaguuagaguuaauguu

SEQ ID NO: 29645 - RNA, 21 nt, Artificial Sequence
  Description of Artificial Sequence: Synthetic oligonucleotide
ugucacaguuagaguuaauuu

SEQ ID NO: 29646 - RNA, 21 nt, Artificial Sequence
  Description of Artificial Sequence: Synthetic oligonucleotide
uugucacaguuagaguuaauu

SEQ ID NO: 29647 - RNA, 21 nt, Artificial Sequence
  Description of Artificial Sequence: Synthetic oligonucleotide
uuugucacaguuagaguuauu

SEQ ID NO: 29648 - RNA, 21 nt, Artificial Sequence
  Description of Artificial Sequence: Synthetic oligonucleotide
uuuugucacaguuagaguuuu

SEQ ID NO: 29649 - RNA, 21 nt, Artificial Sequence
  Description of Artificial Sequence: Synthetic oligonucleotide
ucuuugucacaguuagaguuu

SEQ ID NO: 29650 - RNA, 21 nt, Artificial Sequence
  Description of Artificial Sequence: Synthetic oligonucleotide
uucuuugucacaguuagaguu

SEQ ID NO: 29651 - RNA, 21 nt, Artificial Sequence
  Description of Artificial Sequence: Synthetic oligonucleotide
uuucuuugucacaguuagauu

SEQ ID NO: 29652 - RNA, 21 nt, Artificial Sequence
  Description of Artificial Sequence: Synthetic oligonucleotide
ucuucuuugucacaguuaguu

SEQ ID NO: 29653 - RNA, 21 nt, Artificial Sequence
  Description of Artificial Sequence: Synthetic oligonucleotide
uucuucuuugucacaguuauu

SEQ ID NO: 29654 - RNA, 21 nt, Artificial Sequence
  Description of Artificial Sequence: Synthetic oligonucleotide
ugucuucuuugucacaguuuu

SEQ ID NO: 29655 - RNA, 21 nt, Artificial Sequence
  Description of Artificial Sequence: Synthetic oligonucleotide
uggucuucuuugucacaguuu

SEQ ID NO: 29656 - RNA, 21 nt, Artificial Sequence
  Description of Artificial Sequence: Synthetic oligonucleotide
uuggucuucuuugucacaguu

SEQ ID NO: 29657 - RNA, 21 nt, Artificial Sequence
  Description of Artificial Sequence: Synthetic oligonucleotide
uguggucuucuuugucacauu

SEQ ID NO: 29658 - RNA, 21 nt, Artificial Sequence
  Description of Artificial Sequence: Synthetic oligonucleotide
uuguggucuucuuugucacuu

SEQ ID NO: 29659 - RNA, 21 nt, Artificial Sequence
  Description of Artificial Sequence: Synthetic oligonucleotide
uuuguggucuucuuugucauu

SEQ ID NO: 29660 - RNA, 21 nt, Artificial Sequence
  Description of Artificial Sequence: Synthetic oligonucleotide
uuuuguggucuucuuugucuu

SEQ ID NO: 29661 - RNA, 21 nt, Artificial Sequence
  Description of Artificial Sequence: Synthetic oligonucleotide
uauuuguggucuucuuuguuu

SEQ ID NO: 29662 - RNA, 21 nt, Artificial Sequence
  Description of Artificial Sequence: Synthetic oligonucleotide
uuauuuguggucuucuuuguu

SEQ ID NO: 29663 - RNA, 21 nt, Artificial Sequence
  Description of Artificial Sequence: Synthetic oligonucleotide
ucuauuuguggucuucuuuuu

SEQ ID NO: 29664 - RNA, 21 nt, Artificial Sequence
  Description of Artificial Sequence: Synthetic oligonucleotide
uacuauuuguggucuucuuuu

SEQ ID NO: 29665 - RNA, 21 nt, Artificial Sequence
  Description of Artificial Sequence: Synthetic oligonucleotide
uaacuauuuguggucuucuuu

SEQ ID NO: 29666 - RNA, 21 nt, Artificial Sequence
  Description of Artificial Sequence: Synthetic oligonucleotide
uuaacuauuuguggucuucuu

SEQ ID NO: 29667 - RNA, 21 nt, Artificial Sequence
  Description of Artificial Sequence: Synthetic oligonucleotide
uauaacuauuuguggucuuuu

SEQ ID NO: 29668 - RNA, 21 nt, Artificial Sequence
  Description of Artificial Sequence: Synthetic oligonucleotide
ugauaacuauuuguggucuuu

SEQ ID NO: 29669 - RNA, 21 nt, Artificial Sequence
  Description of Artificial Sequence: Synthetic oligonucleotide
uagauaacuauuuguggucuu

SEQ ID NO: 29670 - RNA, 21 nt, Artificial Sequence
  Description of Artificial Sequence: Synthetic oligonucleotide
uaagauaacuauuugugguuu

SEQ ID NO: 29671 - RNA, 21 nt, Artificial Sequence
  Description of Artificial Sequence: Synthetic oligonucleotide
uaaagauaacuauuugugguu

SEQ ID NO: 29672 - RNA, 21 nt, Artificial Sequence
  Description of Artificial Sequence: Synthetic oligonucleotide
uaaaagauaacuauuuguguu

SEQ ID NO: 29673 - RNA, 21 nt, Artificial Sequence
  Description of Artificial Sequence: Synthetic oligonucleotide
uuaaaagauaacuauuuguuu

SEQ ID NO: 29674 - RNA, 21 nt, Artificial Sequence
  Description of Artificial Sequence: Synthetic oligonucleotide
uuuaaaagauaacuauuuguu

SEQ ID NO: 29675 - RNA, 21 nt, Artificial Sequence
  Description of Artificial Sequence: Synthetic oligonucleotide
uauuaaaagauaacuauuuuu

SEQ ID NO: 29676 - RNA, 21 nt, Artificial Sequence
  Description of Artificial Sequence: Synthetic oligonucleotide
uaauuaaaagauaacuauuuu

SEQ ID NO: 29677 - RNA, 21 nt, Artificial Sequence
  Description of Artificial Sequence: Synthetic oligonucleotide
uuaauuaaaagauaacuauuu

SEQ ID NO: 29678 - RNA, 21 nt, Artificial Sequence
  Description of Artificial Sequence: Synthetic oligonucleotide
uguaauuaaaagauaacuauu

SEQ ID NO: 29679 - RNA, 21 nt, Artificial Sequence
  Description of Artificial Sequence: Synthetic oligonucleotide
uuguaauuaaaagauaacuuu

SEQ ID NO: 29680 - RNA, 21 nt, Artificial Sequence
  Description of Artificial Sequence: Synthetic oligonucleotide
ucuguaauuaaaagauaacuu

SEQ ID NO: 29681 - RNA, 21 nt, Artificial Sequence
  Description of Artificial Sequence: Synthetic oligonucleotide
uucuguaauuaaaagauaauu

SEQ ID NO: 29682 - RNA, 21 nt, Artificial Sequence
  Description of Artificial Sequence: Synthetic oligonucleotide
uuucuguaauuaaaagauauu

SEQ ID NO: 29683 - RNA, 21 nt, Artificial Sequence
  Description of Artificial Sequence: Synthetic oligonucleotide
ucuucuguaauuaaaagauuu

SEQ ID NO: 29684 - RNA, 21 nt, Artificial Sequence
  Description of Artificial Sequence: Synthetic oligonucleotide
uucuucuguaauuaaaagauu

SEQ ID NO: 29685 - RNA, 21 nt, Artificial Sequence
  Description of Artificial Sequence: Synthetic oligonucleotide
ucucuucuguaauuaaaaguu

SEQ ID NO: 29686 - RNA, 21 nt, Artificial Sequence
  Description of Artificial Sequence: Synthetic oligonucleotide
uacucuucuguaauuaaaauu

SEQ ID NO: 29687 - RNA, 21 nt, Artificial Sequence
  Description of Artificial Sequence: Synthetic oligonucleotide
uaacucuucuguaauuaaauu

SEQ ID NO: 29688 - RNA, 21 nt, Artificial Sequence
  Description of Artificial Sequence: Synthetic oligonucleotide
uaaacucuucuguaauuaauu

SEQ ID NO: 29689 - RNA, 21 nt, Artificial Sequence
  Description of Artificial Sequence: Synthetic oligonucleotide
ugaaacucuucuguaauuauu

SEQ ID NO: 29690 - RNA, 21 nt, Artificial Sequence
  Description of Artificial Sequence: Synthetic oligonucleotide
uagaaacucuucuguaauuuu

SEQ ID NO: 29691 - RNA, 21 nt, Artificial Sequence
  Description of Artificial Sequence: Synthetic oligonucleotide
uaagaaacucuucuguaauuu

SEQ ID NO: 29692 - RNA, 21 nt, Artificial Sequence
  Description of Artificial Sequence: Synthetic oligonucleotide
uuaagaaacucuucuguaauu

SEQ ID NO: 29693 - RNA, 21 nt, Artificial Sequence
  Description of Artificial Sequence: Synthetic oligonucleotide
uuuaagaaacucuucuguauu

SEQ ID NO: 29694 - RNA, 21 nt, Artificial Sequence
  Description of Artificial Sequence: Synthetic oligonucleotide
uguuaagaaacucuucuguuu

SEQ ID NO: 29695 - RNA, 21 nt, Artificial Sequence
  Description of Artificial Sequence: Synthetic oligonucleotide
uaguuaagaaacucuucuguu

SEQ ID NO: 29696 - RNA, 21 nt, Artificial Sequence
  Description of Artificial Sequence: Synthetic oligonucleotide
uaaguuaagaaacucuucuuu

SEQ ID NO: 29697 - RNA, 21 nt, Artificial Sequence
  Description of Artificial Sequence: Synthetic oligonucleotide
uuaaguuaagaaacucuucuu

SEQ ID NO: 29698 - RNA, 21 nt, Artificial Sequence
  Description of Artificial Sequence: Synthetic oligonucleotide
uguaaguuaagaaacucuuuu

SEQ ID NO: 29699 - RNA, 21 nt, Artificial Sequence
  Description of Artificial Sequence: Synthetic oligonucleotide
uaguaaguuaagaaacucuuu

SEQ ID NO: 29700 - RNA, 21 nt, Artificial Sequence
  Description of Artificial Sequence: Synthetic oligonucleotide
uaaguaaguuaagaaacucuu

SEQ ID NO: 29701 - RNA, 21 nt, Artificial Sequence
  Description of Artificial Sequence: Synthetic oligonucleotide
uaaaguaaguuaagaaacuuu

SEQ ID NO: 29702 - RNA, 21 nt, Artificial Sequence
  Description of Artificial Sequence: Synthetic oligonucleotide
uaaaaguaaguuaagaaacuu

SEQ ID NO: 29703 - RNA, 21 nt, Artificial Sequence
  Description of Artificial Sequence: Synthetic oligonucleotide
ucaaaaguaaguuaagaaauu

SEQ ID NO: 29704 - RNA, 21 nt, Artificial Sequence
  Description of Artificial Sequence: Synthetic oligonucleotide
uacaaaaguaaguuaagaauu

SEQ ID NO: 29705 - RNA, 21 nt, Artificial Sequence
  Description of Artificial Sequence: Synthetic oligonucleotide
uuacaaaaguaaguuaagauu

SEQ ID NO: 29706 - RNA, 21 nt, Artificial Sequence
  Description of Artificial Sequence: Synthetic oligonucleotide
uuuacaaaaguaaguuaaguu

SEQ ID NO: 29707 - RNA, 21 nt, Artificial Sequence
  Description of Artificial Sequence: Synthetic oligonucleotide
ucuuacaaaaguaaguuaauu

SEQ ID NO: 29708 - RNA, 21 nt, Artificial Sequence
  Description of Artificial Sequence: Synthetic oligonucleotide
uacuuacaaaaguaaguuauu

SEQ ID NO: 29709 - RNA, 21 nt, Artificial Sequence
  Description of Artificial Sequence: Synthetic oligonucleotide
uaacuuacaaaaguaaguuuu

SEQ ID NO: 29710 - RNA, 21 nt, Artificial Sequence
  Description of Artificial Sequence: Synthetic oligonucleotide
uaaacuuacaaaaguaaguuu

SEQ ID NO: 29711 - RNA, 21 nt, Artificial Sequence
  Description of Artificial Sequence: Synthetic oligonucleotide
uaaaacuuacaaaaguaaguu

SEQ ID NO: 29712 - RNA, 21 nt, Artificial Sequence
  Description of Artificial Sequence: Synthetic oligonucleotide
uaaaaacuuacaaaaguaauu

SEQ ID NO: 29713 - RNA, 21 nt, Artificial Sequence
  Description of Artificial Sequence: Synthetic oligonucleotide
uuaaaaacuuacaaaaguauu

SEQ ID NO: 29714 - RNA, 21 nt, Artificial Sequence
  Description of Artificial Sequence: Synthetic oligonucleotide
uauaaaaacuuacaaaaguuu

SEQ ID NO: 29715 - RNA, 21 nt, Artificial Sequence
  Description of Artificial Sequence: Synthetic oligonucleotide
uaauaaaaacuuacaaaaguu

SEQ ID NO: 29716 - RNA, 21 nt, Artificial Sequence
  Description of Artificial Sequence: Synthetic oligonucleotide
ucaauaaaaacuuacaaaauu

SEQ ID NO: 29717 - RNA, 21 nt, Artificial Sequence
  Description of Artificial Sequence: Synthetic oligonucleotide
uacaauaaaaacuuacaaauu

SEQ ID NO: 29718 - RNA, 21 nt, Artificial Sequence
  Description of Artificial Sequence: Synthetic oligonucleotide
ucacaauaaaaacuuacaauu

SEQ ID NO: 29719 - RNA, 21 nt, Artificial Sequence
  Description of Artificial Sequence: Synthetic oligonucleotide
uacacaauaaaaacuuacauu

SEQ ID NO: 29720 - RNA, 21 nt, Artificial Sequence
  Description of Artificial Sequence: Synthetic oligonucleotide
uuacacaauaaaaacuuacuu

SEQ ID NO: 29721 - RNA, 21 nt, Artificial Sequence
  Description of Artificial Sequence: Synthetic oligonucleotide
uuuacacaauaaaaacuuauu

SEQ ID NO: 29722 - RNA, 21 nt, Artificial Sequence
  Description of Artificial Sequence: Synthetic oligonucleotide
ucuuacacaauaaaaacuuuu

SEQ ID NO: 29723 - RNA, 21 nt, Artificial Sequence
  Description of Artificial Sequence: Synthetic oligonucleotide
uacuuacacaauaaaaacuuu

SEQ ID NO: 29724 - RNA, 21 nt, Artificial Sequence
  Description of Artificial Sequence: Synthetic oligonucleotide
uaacuuacacaauaaaaacuu

SEQ ID NO: 29725 - RNA, 21 nt, Artificial Sequence
  Description of Artificial Sequence: Synthetic oligonucleotide
uaaacuuacacaauaaaaauu

SEQ ID NO: 29726 - RNA, 21 nt, Artificial Sequence
  Description of Artificial Sequence: Synthetic oligonucleotide
uuaaacuuacacaauaaaauu

SEQ ID NO: 29727 - RNA, 21 nt, Artificial Sequence
  Description of Artificial Sequence: Synthetic oligonucleotide
uauaaacuuacacaauaaauu

SEQ ID NO: 29728 - RNA, 21 nt, Artificial Sequence
  Description of Artificial Sequence: Synthetic oligonucleotide
uuauaaacuuacacaauaauu

SEQ ID NO: 29729 - RNA, 21 nt, Artificial Sequence
  Description of Artificial Sequence: Synthetic oligonucleotide
uuuauaaacuuacacaauauu

SEQ ID NO: 29730 - RNA, 21 nt, Artificial Sequence
  Description of Artificial Sequence: Synthetic oligonucleotide
uauuauaaacuuacacaauuu

SEQ ID NO: 29731 - RNA, 21 nt, Artificial Sequence
  Description of Artificial Sequence: Synthetic oligonucleotide
ucauuauaaacuuacacaauu

SEQ ID NO: 29732 - RNA, 21 nt, Artificial Sequence
  Description of Artificial Sequence: Synthetic oligonucleotide
ugcauuauaaacuuacacauu

SEQ ID NO: 29733 - RNA, 21 nt, Artificial Sequence
  Description of Artificial Sequence: Synthetic oligonucleotide
uugcauuauaaacuuacacuu

SEQ ID NO: 29734 - RNA, 21 nt, Artificial Sequence
  Description of Artificial Sequence: Synthetic oligonucleotide
ucugcauuauaaacuuacauu

SEQ ID NO: 29735 - RNA, 21 nt, Artificial Sequence
  Description of Artificial Sequence: Synthetic oligonucleotide
uccugcauuauaaacuuacuu

SEQ ID NO: 29736 - RNA, 21 nt, Artificial Sequence
  Description of Artificial Sequence: Synthetic oligonucleotide
ucccugcauuauaaacuuauu

SEQ ID NO: 29737 - RNA, 21 nt, Artificial Sequence
  Description of Artificial Sequence: Synthetic oligonucleotide
uccccugcauuauaaacuuuu

SEQ ID NO: 29738 - RNA, 21 nt, Artificial Sequence
  Description of Artificial Sequence: Synthetic oligonucleotide
uuccccugcauuauaaacuuu

SEQ ID NO: 29739 - RNA, 21 nt, Artificial Sequence
  Description of Artificial Sequence: Synthetic oligonucleotide
uuuccccugcauuauaaacuu

SEQ ID NO: 29740 - RNA, 21 nt, Artificial Sequence
  Description of Artificial Sequence: Synthetic oligonucleotide
ucuuccccugcauuauaaauu

SEQ ID NO: 29741 - RNA, 21 nt, Artificial Sequence
  Description of Artificial Sequence: Synthetic oligonucleotide
uacuuccccugcauuauaauu

SEQ ID NO: 29742 - RNA, 21 nt, Artificial Sequence
  Description of Artificial Sequence: Synthetic oligonucleotide
uuacuuccccugcauuauauu

SEQ ID NO: 29743 - RNA, 21 nt, Artificial Sequence
  Description of Artificial Sequence: Synthetic oligonucleotide
uguacuuccccugcauuauuu

SEQ ID NO: 29744 - RNA, 21 nt, Artificial Sequence
  Description of Artificial Sequence: Synthetic oligonucleotide
uaguacuuccccugcauuauu

SEQ ID NO: 29745 - RNA, 21 nt, Artificial Sequence
  Description of Artificial Sequence: Synthetic oligonucleotide
uuaguacuuccccugcauuuu

SEQ ID NO: 29746 - RNA, 21 nt, Artificial Sequence
  Description of Artificial Sequence: Synthetic oligonucleotide
uguaguacuuccccugcauuu

SEQ ID NO: 29747 - RNA, 21 nt, Artificial Sequence
  Description of Artificial Sequence: Synthetic oligonucleotide
uaguaguacuuccccugcauu

SEQ ID NO: 29748 - RNA, 21 nt, Artificial Sequence
  Description of Artificial Sequence: Synthetic oligonucleotide
ugaguaguacuuccccugcuu

SEQ ID NO: 29749 - RNA, 21 nt, Artificial Sequence
  Description of Artificial Sequence: Synthetic oligonucleotide
uggaguaguacuuccccuguu

SEQ ID NO: 29750 - RNA, 21 nt, Artificial Sequence
  Description of Artificial Sequence: Synthetic oligonucleotide
uaggaguaguacuuccccuuu

SEQ ID NO: 29751 - RNA, 21 nt, Artificial Sequence
  Description of Artificial Sequence: Synthetic oligonucleotide
ugaggaguaguacuuccccuu

SEQ ID NO: 29752 - RNA, 21 nt, Artificial Sequence
  Description of Artificial Sequence: Synthetic oligonucleotide
uugaggaguaguacuucccuu

SEQ ID NO: 29753 - RNA, 21 nt, Artificial Sequence
  Description of Artificial Sequence: Synthetic oligonucleotide
uuugaggaguaguacuuccuu

SEQ ID NO: 29754 - RNA, 21 nt, Artificial Sequence
  Description of Artificial Sequence: Synthetic oligonucleotide
uuuugaggaguaguacuucuu

SEQ ID NO: 29755 - RNA, 21 nt, Artificial Sequence
  Description of Artificial Sequence: Synthetic oligonucleotide
uauuugaggaguaguacuuuu

SEQ ID NO: 29756 - RNA, 21 nt, Artificial Sequence
  Description of Artificial Sequence: Synthetic oligonucleotide
ucauuugaggaguaguacuuu

SEQ ID NO: 29757 - RNA, 21 nt, Artificial Sequence
  Description of Artificial Sequence: Synthetic oligonucleotide
uacauuugaggaguaguacuu

SEQ ID NO: 29758 - RNA, 21 nt, Artificial Sequence
  Description of Artificial Sequence: Synthetic oligonucleotide
uaacauuugaggaguaguauu

SEQ ID NO: 29759 - RNA, 21 nt, Artificial Sequence
  Description of Artificial Sequence: Synthetic oligonucleotide
ucaacauuugaggaguaguuu

SEQ ID NO: 29760 - RNA, 21 nt, Artificial Sequence
  Description of Artificial Sequence: Synthetic oligonucleotide
uucaacauuugaggaguaguu

SEQ ID NO: 29761 - RNA, 21 nt, Artificial Sequence
  Description of Artificial Sequence: Synthetic oligonucleotide
ucucaacauuugaggaguauu

SEQ ID NO: 29762 - RNA, 21 nt, Artificial Sequence
  Description of Artificial Sequence: Synthetic oligonucleotide
uccucaacauuugaggaguuu

SEQ ID NO: 29763 - RNA, 21 nt, Artificial Sequence
  Description of Artificial Sequence: Synthetic oligonucleotide
ucccucaacauuugaggaguu

SEQ ID NO: 29764 - RNA, 21 nt, Artificial Sequence
  Description of Artificial Sequence: Synthetic oligonucleotide
uucccucaacauuugaggauu

SEQ ID NO: 29765 - RNA, 21 nt, Artificial Sequence
  Description of Artificial Sequence: Synthetic oligonucleotide
uuucccucaacauuugagguu

SEQ ID NO: 29766 - RNA, 21 nt, Artificial Sequence
  Description of Artificial Sequence: Synthetic oligonucleotide
ucuucccucaacauuugaguu

SEQ ID NO: 29767 - RNA, 21 nt, Artificial Sequence
  Description of Artificial Sequence: Synthetic oligonucleotide
ugcuucccucaacauuugauu

SEQ ID NO: 29768 - RNA, 21 nt, Artificial Sequence
  Description of Artificial Sequence: Synthetic oligonucleotide
uagcuucccucaacauuuguu

SEQ ID NO: 29769 - RNA, 21 nt, Artificial Sequence
  Description of Artificial Sequence: Synthetic oligonucleotide
uaagcuucccucaacauuuuu

SEQ ID NO: 29770 - RNA, 21 nt, Artificial Sequence
  Description of Artificial Sequence: Synthetic oligonucleotide
ugaagcuucccucaacauuuu

SEQ ID NO: 29771 - RNA, 21 nt, Artificial Sequence
  Description of Artificial Sequence: Synthetic oligonucleotide
uggaagcuucccucaacauuu

SEQ ID NO: 29772 - RNA, 21 nt, Artificial Sequence
  Description of Artificial Sequence: Synthetic oligonucleotide
uuggaagcuucccucaacauu

SEQ ID NO: 29773 - RNA, 21 nt, Artificial Sequence
  Description of Artificial Sequence: Synthetic oligonucleotide
uauggaagcuucccucaacuu

SEQ ID NO: 29774 - RNA, 21 nt, Artificial Sequence
  Description of Artificial Sequence: Synthetic oligonucleotide
uuauggaagcuucccucaauu

SEQ ID NO: 29775 - RNA, 21 nt, Artificial Sequence
  Description of Artificial Sequence: Synthetic oligonucleotide
uuuauggaagcuucccucauu

SEQ ID NO: 29776 - RNA, 21 nt, Artificial Sequence
  Description of Artificial Sequence: Synthetic oligonucleotide
uguuauggaagcuucccucuu

SEQ ID NO: 29777 - RNA, 21 nt, Artificial Sequence
  Description of Artificial Sequence: Synthetic oligonucleotide
uuguuauggaagcuucccuuu

SEQ ID NO: 29778 - RNA, 21 nt, Artificial Sequence
  Description of Artificial Sequence: Synthetic oligonucleotide
uauguuauggaagcuucccuu

SEQ ID NO: 29779 - RNA, 21 nt, Artificial Sequence
  Description of Artificial Sequence: Synthetic oligonucleotide
uaauguuauggaagcuuccuu

SEQ ID NO: 29780 - RNA, 21 nt, Artificial Sequence
  Description of Artificial Sequence: Synthetic oligonucleotide
ucaauguuauggaagcuucuu

SEQ ID NO: 29781 - RNA, 21 nt, Artificial Sequence
  Description of Artificial Sequence: Synthetic oligonucleotide
uucaauguuauggaagcuuuu

SEQ ID NO: 29782 - RNA, 21 nt, Artificial Sequence
  Description of Artificial Sequence: Synthetic oligonucleotide
uaucaauguuauggaagcuuu

SEQ ID NO: 29783 - RNA, 21 nt, Artificial Sequence
  Description of Artificial Sequence: Synthetic oligonucleotide
ucaucaauguuauggaagcuu

SEQ ID NO: 29784 - RNA, 21 nt, Artificial Sequence
  Description of Artificial Sequence: Synthetic oligonucleotide
uucaucaauguuauggaaguu

SEQ ID NO: 29785 - RNA, 21 nt, Artificial Sequence
  Description of Artificial Sequence: Synthetic oligonucleotide
ugucaucaauguuauggaauu

SEQ ID NO: 29786 - RNA, 21 nt, Artificial Sequence
  Description of Artificial Sequence: Synthetic oligonucleotide
uagucaucaauguuauggauu

SEQ ID NO: 29787 - RNA, 21 nt, Artificial Sequence
  Description of Artificial Sequence: Synthetic oligonucleotide
ucagucaucaauguuaugguu

SEQ ID NO: 29788 - RNA, 21 nt, Artificial Sequence
  Description of Artificial Sequence: Synthetic oligonucleotide
uccagucaucaauguuauguu

SEQ ID NO: 29789 - RNA, 21 nt, Artificial Sequence
  Description of Artificial Sequence: Synthetic oligonucleotide
ugccagucaucaauguuauuu

SEQ ID NO: 29790 - RNA, 21 nt, Artificial Sequence
  Description of Artificial Sequence: Synthetic oligonucleotide
uagccagucaucaauguuauu

SEQ ID NO: 29791 - RNA, 21 nt, Artificial Sequence
  Description of Artificial Sequence: Synthetic oligonucleotide
uaagccagucaucaauguuuu

SEQ ID NO: 29792 - RNA, 21 nt, Artificial Sequence
  Description of Artificial Sequence: Synthetic oligonucleotide
ugaagccagucaucaauguuu

SEQ ID NO: 29793 - RNA, 21 nt, Artificial Sequence
  Description of Artificial Sequence: Synthetic oligonucleotide
uugaagccagucaucaauguu

SEQ ID NO: 29794 - RNA, 21 nt, Artificial Sequence
  Description of Artificial Sequence: Synthetic oligonucleotide
uaugaagccagucaucaauuu

SEQ ID NO: 29795 - RNA, 21 nt, Artificial Sequence
  Description of Artificial Sequence: Synthetic oligonucleotide
ucaugaagccagucaucaauu

SEQ ID NO: 29796 - RNA, 21 nt, Artificial Sequence
  Description of Artificial Sequence: Synthetic oligonucleotide
uccaugaagccagucaucauu

SEQ ID NO: 29797 - RNA, 21 nt, Artificial Sequence
  Description of Artificial Sequence: Synthetic oligonucleotide
ugccaugaagccagucaucuu

SEQ ID NO: 29798 - RNA, 21 nt, Artificial Sequence
  Description of Artificial Sequence: Synthetic oligonucleotide
uugccaugaagccagucauuu

SEQ ID NO: 29799 - RNA, 21 nt, Artificial Sequence
  Description of Artificial Sequence: Synthetic oligonucleotide
ucugccaugaagccagucauu

SEQ ID NO: 29800 - RNA, 21 nt, Artificial Sequence
  Description of Artificial Sequence: Synthetic oligonucleotide
uacugccaugaagccagucuu

SEQ ID NO: 29801 - RNA, 21 nt, Artificial Sequence
  Description of Artificial Sequence: Synthetic oligonucleotide
uuacugccaugaagccaguuu

SEQ ID NO: 29802 - RNA, 21 nt, Artificial Sequence
  Description of Artificial Sequence: Synthetic oligonucleotide
uuuacugccaugaagccaguu

SEQ ID NO: 29803 - RNA, 21 nt, Artificial Sequence
  Description of Artificial Sequence: Synthetic oligonucleotide
uauuacugccaugaagccauu

SEQ ID NO: 29804 - RNA, 21 nt, Artificial Sequence
  Description of Artificial Sequence: Synthetic oligonucleotide
uaauuacugccaugaagccuu

SEQ ID NO: 29805 - RNA, 21 nt, Artificial Sequence
  Description of Artificial Sequence: Synthetic oligonucleotide
ugaauuacugccaugaagcuu

SEQ ID NO: 29806 - RNA, 21 nt, Artificial Sequence
  Description of Artificial Sequence: Synthetic oligonucleotide
uagaauuacugccaugaaguu

SEQ ID NO: 29807 - RNA, 21 nt, Artificial Sequence
  Description of Artificial Sequence: Synthetic oligonucleotide
ugagaauuacugccaugaauu

SEQ ID NO: 29808 - RNA, 21 nt, Artificial Sequence
  Description of Artificial Sequence: Synthetic oligonucleotide
ucgagaauuacugccaugauu

SEQ ID NO: 29809 - RNA, 21 nt, Artificial Sequence
  Description of Artificial Sequence: Synthetic oligonucleotide
uccgagaauuacugccauguu

SEQ ID NO: 29810 - RNA, 21 nt, Artificial Sequence
  Description of Artificial Sequence: Synthetic oligonucleotide
ugccgagaauuacugccauuu

SEQ ID NO: 29811 - RNA, 21 nt, Artificial Sequence
  Description of Artificial Sequence: Synthetic oligonucleotide
uagccgagaauuacugccauu

SEQ ID NO: 29812 - RNA, 21 nt, Artificial Sequence
  Description of Artificial Sequence: Synthetic oligonucleotide
ucagccgagaauuacugccuu

SEQ ID NO: 29813 - RNA, 21 nt, Artificial Sequence
  Description of Artificial Sequence: Synthetic oligonucleotide
uacagccgagaauuacugcuu

SEQ ID NO: 29814 - RNA, 21 nt, Artificial Sequence
  Description of Artificial Sequence: Synthetic oligonucleotide
uuacagccgagaauuacuguu

SEQ ID NO: 29815 - RNA, 21 nt, Artificial Sequence
  Description of Artificial Sequence: Synthetic oligonucleotide
ucuacagccgagaauuacuuu

SEQ ID NO: 29816 - RNA, 21 nt, Artificial Sequence
  Description of Artificial Sequence: Synthetic oligonucleotide
uacuacagccgagaauuacuu

SEQ ID NO: 29817 - RNA, 21 nt, Artificial Sequence
  Description of Artificial Sequence: Synthetic oligonucleotide
uaacuacagccgagaauuauu

SEQ ID NO: 29818 - RNA, 21 nt, Artificial Sequence
  Description of Artificial Sequence: Synthetic oligonucleotide
ucaacuacagccgagaauuuu

SEQ ID NO: 29819 - RNA, 21 nt, Artificial Sequence
  Description of Artificial Sequence: Synthetic oligonucleotide
ugcaacuacagccgagaauuu

SEQ ID NO: 29820 - RNA, 21 nt, Artificial Sequence
  Description of Artificial Sequence: Synthetic oligonucleotide
uugcaacuacagccgagaauu

SEQ ID NO: 29821 - RNA, 21 nt, Artificial Sequence
  Description of Artificial Sequence: Synthetic oligonucleotide
uaugcaacuacagccgagauu

SEQ ID NO: 29822 - RNA, 21 nt, Artificial Sequence
  Description of Artificial Sequence: Synthetic oligonucleotide
uuaugcaacuacagccgaguu

SEQ ID NO: 29823 - RNA, 21 nt, Artificial Sequence
  Description of Artificial Sequence: Synthetic oligonucleotide
uuuaugcaacuacagccgauu

SEQ ID NO: 29824 - RNA, 21 nt, Artificial Sequence
  Description of Artificial Sequence: Synthetic oligonucleotide
ucuuaugcaacuacagccguu

SEQ ID NO: 29825 - RNA, 21 nt, Artificial Sequence
  Description of Artificial Sequence: Synthetic oligonucleotide
ugcuuaugcaacuacagccuu

SEQ ID NO: 29826 - RNA, 21 nt, Artificial Sequence
  Description of Artificial Sequence: Synthetic oligonucleotide
uugcuuaugcaacuacagcuu

SEQ ID NO: 29827 - RNA, 21 nt, Artificial Sequence
  Description of Artificial Sequence: Synthetic oligonucleotide
uaugcuuaugcaacuacaguu

SEQ ID NO: 29828 - RNA, 21 nt, Artificial Sequence
  Description of Artificial Sequence: Synthetic oligonucleotide
uaaugcuuaugcaacuacauu

SEQ ID NO: 29829 - RNA, 21 nt, Artificial Sequence
  Description of Artificial Sequence: Synthetic oligonucleotide
ucaaugcuuaugcaacuacuu

SEQ ID NO: 29830 - RNA, 21 nt, Artificial Sequence
  Description of Artificial Sequence: Synthetic oligonucleotide
ugcaaugcuuaugcaacuauu

SEQ ID NO: 29831 - RNA, 21 nt, Artificial Sequence
  Description of Artificial Sequence: Synthetic oligonucleotide
uagcaaugcuuaugcaacuuu

SEQ ID NO: 29832 - RNA, 21 nt, Artificial Sequence
  Description of Artificial Sequence: Synthetic oligonucleotide
ugagcaaugcuuaugcaacuu

SEQ ID NO: 29833 - RNA, 21 nt, Artificial Sequence
  Description of Artificial Sequence: Synthetic oligonucleotide
uugagcaaugcuuaugcaauu

SEQ ID NO: 29834 - RNA, 21 nt, Artificial Sequence
  Description of Artificial Sequence: Synthetic oligonucleotide
uuugagcaaugcuuaugcauu

SEQ ID NO: 29835 - RNA, 21 nt, Artificial Sequence
  Description of Artificial Sequence: Synthetic oligonucleotide
ucuugagcaaugcuuaugcuu

SEQ ID NO: 29836 - RNA, 21 nt, Artificial Sequence
  Description of Artificial Sequence: Synthetic oligonucleotide
uucuugagcaaugcuuauguu

SEQ ID NO: 29837 - RNA, 21 nt, Artificial Sequence
  Description of Artificial Sequence: Synthetic oligonucleotide
ucucuugagcaaugcuuauuu

SEQ ID NO: 29838 - RNA, 21 nt, Artificial Sequence
  Description of Artificial Sequence: Synthetic oligonucleotide
uccucuugagcaaugcuuauu

SEQ ID NO: 29839 - RNA, 21 nt, Artificial Sequence
  Description of Artificial Sequence: Synthetic oligonucleotide
uuccucuugagcaaugcuuuu

SEQ ID NO: 29840 - RNA, 21 nt, Artificial Sequence
  Description of Artificial Sequence: Synthetic oligonucleotide
uuuccucuugagcaaugcuuu

SEQ ID NO: 29841 - RNA, 21 nt, Artificial Sequence
  Description of Artificial Sequence: Synthetic oligonucleotide
uuuuccucuugagcaaugcuu

SEQ ID NO: 29842 - RNA, 21 nt, Artificial Sequence
  Description of Artificial Sequence: Synthetic oligonucleotide
uuuuuccucuugagcaauguu

SEQ ID NO: 29843 - RNA, 21 nt, Artificial Sequence
  Description of Artificial Sequence: Synthetic oligonucleotide
uauuuuccucuugagcaauuu

SEQ ID NO: 29844 - RNA, 21 nt, Artificial Sequence
  Description of Artificial Sequence: Synthetic oligonucleotide
ugauuuuccucuugagcaauu

SEQ ID NO: 29845 - RNA, 21 nt, Artificial Sequence
  Description of Artificial Sequence: Synthetic oligonucleotide
uggauuuuccucuugagcauu

SEQ ID NO: 29846 - RNA, 21 nt, Artificial Sequence
  Description of Artificial Sequence: Synthetic oligonucleotide
uuggauuuuccucuugagcuu

SEQ ID NO: 29847 - RNA, 21 nt, Artificial Sequence
  Description of Artificial Sequence: Synthetic oligonucleotide
uuuggauuuuccucuugaguu

SEQ ID NO: 29848 - RNA, 21 nt, Artificial Sequence
  Description of Artificial Sequence: Synthetic oligonucleotide
uuuuggauuuuccucuugauu

SEQ ID NO: 29849 - RNA, 21 nt, Artificial Sequence
  Description of Artificial Sequence: Synthetic oligonucleotide
uuuuuggauuuuccucuuguu

SEQ ID NO: 29850 - RNA, 21 nt, Artificial Sequence
  Description of Artificial Sequence: Synthetic oligonucleotide
ucuuuuggauuuuccucuuuu

SEQ ID NO: 29851 - RNA, 21 nt, Artificial Sequence
  Description of Artificial Sequence: Synthetic oligonucleotide
uacuuuuggauuuuccucuuu

SEQ ID NO: 29852 - RNA, 21 nt, Artificial Sequence
  Description of Artificial Sequence: Synthetic oligonucleotide
ucacuuuuggauuuuccucuu

SEQ ID NO: 29853 - RNA, 21 nt, Artificial Sequence
  Description of Artificial Sequence: Synthetic oligonucleotide
ugcacuuuuggauuuuccuuu

SEQ ID NO: 29854 - RNA, 21 nt, Artificial Sequence
  Description of Artificial Sequence: Synthetic oligonucleotide
uugcacuuuuggauuuuccuu

SEQ ID NO: 29855 - RNA, 21 nt, Artificial Sequence
  Description of Artificial Sequence: Synthetic oligonucleotide
ucugcacuuuuggauuuucuu

SEQ ID NO: 29856 - RNA, 21 nt, Artificial Sequence
  Description of Artificial Sequence: Synthetic oligonucleotide
ugcugcacuuuuggauuuuuu

SEQ ID NO: 29857 - RNA, 21 nt, Artificial Sequence
  Description of Artificial Sequence: Synthetic oligonucleotide
uugcugcacuuuuggauuuuu

SEQ ID NO: 29858 - RNA, 21 nt, Artificial Sequence
  Description of Artificial Sequence: Synthetic oligonucleotide
ucugcugcacuuuuggauuuu

SEQ ID NO: 29859 - RNA, 21 nt, Artificial Sequence
  Description of Artificial Sequence: Synthetic oligonucleotide
uccugcugcacuuuuggauuu

SEQ ID NO: 29860 - RNA, 21 nt, Artificial Sequence
  Description of Artificial Sequence: Synthetic oligonucleotide
uuccugcugcacuuuuggauu

SEQ ID NO: 29861 - RNA, 21 nt, Artificial Sequence
  Description of Artificial Sequence: Synthetic oligonucleotide
ucuccugcugcacuuuugguu

SEQ ID NO: 29862 - RNA, 21 nt, Artificial Sequence
  Description of Artificial Sequence: Synthetic oligonucleotide
uucuccugcugcacuuuuguu

SEQ ID NO: 29863 - RNA, 21 nt, Artificial Sequence
  Description of Artificial Sequence: Synthetic oligonucleotide
uuucuccugcugcacuuuuuu

SEQ ID NO: 29864 - RNA, 21 nt, Artificial Sequence
  Description of Artificial Sequence: Synthetic oligonucleotide
uguucuccugcugcacuuuuu

SEQ ID NO: 29865 - RNA, 21 nt, Artificial Sequence
  Description of Artificial Sequence: Synthetic oligonucleotide
uaguucuccugcugcacuuuu

SEQ ID NO: 29866 - RNA, 21 nt, Artificial Sequence
  Description of Artificial Sequence: Synthetic oligonucleotide
ugaguucuccugcugcacuuu

SEQ ID NO: 29867 - RNA, 21 nt, Artificial Sequence
  Description of Artificial Sequence: Synthetic oligonucleotide
uagaguucuccugcugcacuu

SEQ ID NO: 29868 - RNA, 21 nt, Artificial Sequence
  Description of Artificial Sequence: Synthetic oligonucleotide
uaagaguucuccugcugcauu

SEQ ID NO: 29869 - RNA, 21 nt, Artificial Sequence
  Description of Artificial Sequence: Synthetic oligonucleotide
uaaagaguucuccugcugcuu

SEQ ID NO: 29870 - RNA, 21 nt, Artificial Sequence
  Description of Artificial Sequence: Synthetic oligonucleotide
uaaaagaguucuccugcuguu

SEQ ID NO: 29871 - RNA, 21 nt, Artificial Sequence
  Description of Artificial Sequence: Synthetic oligonucleotide
ugaaaagaguucuccugcuuu

SEQ ID NO: 29872 - RNA, 21 nt, Artificial Sequence
  Description of Artificial Sequence: Synthetic oligonucleotide
uggaaaagaguucuccugcuu

SEQ ID NO: 29873 - RNA, 21 nt, Artificial Sequence
  Description of Artificial Sequence: Synthetic oligonucleotide
ugggaaaagaguucuccuguu

SEQ ID NO: 29874 - RNA, 21 nt, Artificial Sequence
  Description of Artificial Sequence: Synthetic oligonucleotide
uagggaaaagaguucuccuuu

SEQ ID NO: 29875 - RNA, 21 nt, Artificial Sequence
  Description of Artificial Sequence: Synthetic oligonucleotide
ucagggaaaagaguucuccuu

SEQ ID NO: 29876 - RNA, 21 nt, Artificial Sequence
  Description of Artificial Sequence: Synthetic oligonucleotide
uucagggaaaagaguucucuu

SEQ ID NO: 29877 - RNA, 21 nt, Artificial Sequence
  Description of Artificial Sequence: Synthetic oligonucleotide
uuucagggaaaagaguucuuu

SEQ ID NO: 29878 - RNA, 21 nt, Artificial Sequence
  Description of Artificial Sequence: Synthetic oligonucleotide
uuuucagggaaaagaguucuu

SEQ ID NO: 29879 - RNA, 21 nt, Artificial Sequence
  Description of Artificial Sequence: Synthetic oligonucleotide
uuuuucagggaaaagaguuuu

SEQ ID NO: 29880 - RNA, 21 nt, Artificial Sequence
  Description of Artificial Sequence: Synthetic oligonucleotide
uuuuuucagggaaaagaguuu

SEQ ID NO: 29881 - RNA, 21 nt, Artificial Sequence
  Description of Artificial Sequence: Synthetic oligonucleotide
ucuuuuucagggaaaagaguu

SEQ ID NO: 29882 - RNA, 21 nt, Artificial Sequence
  Description of Artificial Sequence: Synthetic oligonucleotide
uccuuuuucagggaaaagauu

SEQ ID NO: 29883 - RNA, 21 nt, Artificial Sequence
  Description of Artificial Sequence: Synthetic oligonucleotide
uuccuuuuucagggaaaaguu

SEQ ID NO: 29884 - RNA, 21 nt, Artificial Sequence
  Description of Artificial Sequence: Synthetic oligonucleotide
uuuccuuuuucagggaaaauu

SEQ ID NO: 29885 - RNA, 21 nt, Artificial Sequence
  Description of Artificial Sequence: Synthetic oligonucleotide
uuuuccuuuuucagggaaauu

SEQ ID NO: 29886 - RNA, 21 nt, Artificial Sequence
  Description of Artificial Sequence: Synthetic oligonucleotide
uuuuuccuuuuucagggaauu

SEQ ID NO: 29887 - RNA, 21 nt, Artificial Sequence
  Description of Artificial Sequence: Synthetic oligonucleotide
uuuuuuccuuuuucagggauu

SEQ ID NO: 29888 - RNA, 21 nt, Artificial Sequence
  Description of Artificial Sequence: Synthetic oligonucleotide
uauuuuuccuuuuucaggguu

SEQ ID NO: 29889 - RNA, 21 nt, Artificial Sequence
  Description of Artificial Sequence: Synthetic oligonucleotide
uuauuuuuccuuuuucagguu

SEQ ID NO: 29890 - RNA, 21 nt, Artificial Sequence
  Description of Artificial Sequence: Synthetic oligonucleotide
uauauuuuuccuuuuucaguu

SEQ ID NO: 29891 - RNA, 21 nt, Artificial Sequence
  Description of Artificial Sequence: Synthetic oligonucleotide
uaauauuuuuccuuuuucauu

SEQ ID NO: 29892 - RNA, 21 nt, Artificial Sequence
  Description of Artificial Sequence: Synthetic oligonucleotide
ucaauauuuuuccuuuuucuu

SEQ ID NO: 29893 - RNA, 21 nt, Artificial Sequence
  Description of Artificial Sequence: Synthetic oligonucleotide
uucaauauuuuuccuuuuuuu

SEQ ID NO: 29894 - RNA, 21 nt, Artificial Sequence
  Description of Artificial Sequence: Synthetic oligonucleotide
uuucaauauuuuuccuuuuuu

SEQ ID NO: 29895 - RNA, 21 nt, Artificial Sequence
  Description of Artificial Sequence: Synthetic oligonucleotide
uguucaauauuuuuccuuuuu

SEQ ID NO: 29896 - RNA, 21 nt, Artificial Sequence
  Description of Artificial Sequence: Synthetic oligonucleotide
uaguucaauauuuuuccuuuu

SEQ ID NO: 29897 - RNA, 21 nt, Artificial Sequence
  Description of Artificial Sequence: Synthetic oligonucleotide
ugaguucaauauuuuuccuuu

SEQ ID NO: 29898 - RNA, 21 nt, Artificial Sequence
  Description of Artificial Sequence: Synthetic oligonucleotide
uugaguucaauauuuuuccuu

SEQ ID NO: 29899 - RNA, 21 nt, Artificial Sequence
  Description of Artificial Sequence: Synthetic oligonucleotide
uuugaguucaauauuuuucuu

SEQ ID NO: 29900 - RNA, 21 nt, Artificial Sequence
  Description of Artificial Sequence: Synthetic oligonucleotide
uauugaguucaauauuuuuuu

SEQ ID NO: 29901 - RNA, 21 nt, Artificial Sequence
  Description of Artificial Sequence: Synthetic oligonucleotide
ucauugaguucaauauuuuuu

SEQ ID NO: 29902 - RNA, 21 nt, Artificial Sequence
  Description of Artificial Sequence: Synthetic oligonucleotide
uucauugaguucaauauuuuu

SEQ ID NO: 29903 - RNA, 21 nt, Artificial Sequence
  Description of Artificial Sequence: Synthetic oligonucleotide
uaucauugaguucaauauuuu

SEQ ID NO: 29904 - RNA, 21 nt, Artificial Sequence
  Description of Artificial Sequence: Synthetic oligonucleotide
uuaucauugaguucaauauuu

SEQ ID NO: 29905 - RNA, 21 nt, Artificial Sequence
  Description of Artificial Sequence: Synthetic oligonucleotide
ucuaucauugaguucaauauu

SEQ ID NO: 29906 - RNA, 21 nt, Artificial Sequence
  Description of Artificial Sequence: Synthetic oligonucleotide
ugcuaucauugaguucaauuu

SEQ ID NO: 29907 - RNA, 21 nt, Artificial Sequence
  Description of Artificial Sequence: Synthetic oligonucleotide
uugcuaucauugaguucaauu

SEQ ID NO: 29908 - RNA, 21 nt, Artificial Sequence
  Description of Artificial Sequence: Synthetic oligonucleotide
ugugcuaucauugaguucauu

SEQ ID NO: 29909 - RNA, 21 nt, Artificial Sequence
  Description of Artificial Sequence: Synthetic oligonucleotide
uggugcuaucauugaguucuu

SEQ ID NO: 29910 - RNA, 21 nt, Artificial Sequence
  Description of Artificial Sequence: Synthetic oligonucleotide
uaggugcuaucauugaguuuu

SEQ ID NO: 29911 - RNA, 21 nt, Artificial Sequence
  Description of Artificial Sequence: Synthetic oligonucleotide
uuaggugcuaucauugaguuu

SEQ ID NO: 29912 - RNA, 21 nt, Artificial Sequence
  Description of Artificial Sequence: Synthetic oligonucleotide
uuuaggugcuaucauugaguu

SEQ ID NO: 29913 - RNA, 21 nt, Artificial Sequence
  Description of Artificial Sequence: Synthetic oligonucleotide
uuuuaggugcuaucauugauu

SEQ ID NO: 29914 - RNA, 21 nt, Artificial Sequence
  Description of Artificial Sequence: Synthetic oligonucleotide
uguuuaggugcuaucauuguu

SEQ ID NO: 29915 - RNA, 21 nt, Artificial Sequence
  Description of Artificial Sequence: Synthetic oligonucleotide
uaguuuaggugcuaucauuuu

SEQ ID NO: 29916 - RNA, 21 nt, Artificial Sequence
  Description of Artificial Sequence: Synthetic oligonucleotide
uaaguuuaggugcuaucauuu

SEQ ID NO: 29917 - RNA, 21 nt, Artificial Sequence
  Description of Artificial Sequence: Synthetic oligonucleotide
uuaaguuuaggugcuaucauu

SEQ ID NO: 29918 - RNA, 21 nt, Artificial Sequence
  Description of Artificial Sequence: Synthetic oligonucleotide
uguaaguuuaggugcuaucuu

SEQ ID NO: 29919 - RNA, 21 nt, Artificial Sequence
  Description of Artificial Sequence: Synthetic oligonucleotide
uuguaaguuuaggugcuauuu

SEQ ID NO: 29920 - RNA, 21 nt, Artificial Sequence
  Description of Artificial Sequence: Synthetic oligonucleotide
uauguaaguuuaggugcuauu

SEQ ID NO: 29921 - RNA, 21 nt, Artificial Sequence
  Description of Artificial Sequence: Synthetic oligonucleotide
uaauguaaguuuaggugcuuu

SEQ ID NO: 29922 - RNA, 21 nt, Artificial Sequence
  Description of Artificial Sequence: Synthetic oligonucleotide
uaaauguaaguuuaggugcuu

SEQ ID NO: 29923 - RNA, 21 nt, Artificial Sequence
  Description of Artificial Sequence: Synthetic oligonucleotide
uuaaauguaaguuuagguguu

SEQ ID NO: 29924 - RNA, 21 nt, Artificial Sequence
  Description of Artificial Sequence: Synthetic oligonucleotide
uuuaaauguaaguuuagguuu

SEQ ID NO: 29925 - RNA, 21 nt, Artificial Sequence
  Description of Artificial Sequence: Synthetic oligonucleotide
uuuuaaauguaaguuuagguu

SEQ ID NO: 29926 - RNA, 21 nt, Artificial Sequence
  Description of Artificial Sequence: Synthetic oligonucleotide
uuuuuaaauguaaguuuaguu

SEQ ID NO: 29927 - RNA, 21 nt, Artificial Sequence
  Description of Artificial Sequence: Synthetic oligonucleotide
ucuuuuaaauguaaguuuauu

SEQ ID NO: 29928 - RNA, 21 nt, Artificial Sequence
  Description of Artificial Sequence: Synthetic oligonucleotide
uucuuuuaaauguaaguuuuu

SEQ ID NO: 29929 - RNA, 21 nt, Artificial Sequence
  Description of Artificial Sequence: Synthetic oligonucleotide
ugucuuuuaaauguaaguuuu

SEQ ID NO: 29930 - RNA, 21 nt, Artificial Sequence
  Description of Artificial Sequence: Synthetic oligonucleotide
uugucuuuuaaauguaaguuu

SEQ ID NO: 29931 - RNA, 21 nt, Artificial Sequence
  Description of Artificial Sequence: Synthetic oligonucleotide
ucugucuuuuaaauguaaguu

SEQ ID NO: 29932 - RNA, 21 nt, Artificial Sequence
  Description of Artificial Sequence: Synthetic oligonucleotide
uucugucuuuuaaauguaauu

SEQ ID NO: 29933 - RNA, 21 nt, Artificial Sequence
  Description of Artificial Sequence: Synthetic oligonucleotide
ugucugucuuuuaaauguauu

SEQ ID NO: 29934 - RNA, 21 nt, Artificial Sequence
  Description of Artificial Sequence: Synthetic oligonucleotide
uugucugucuuuuaaauguuu

SEQ ID NO: 29935 - RNA, 21 nt, Artificial Sequence
  Description of Artificial Sequence: Synthetic oligonucleotide
uaugucugucuuuuaaauguu

SEQ ID NO: 29936 - RNA, 21 nt, Artificial Sequence
  Description of Artificial Sequence: Synthetic oligonucleotide
uaaugucugucuuuuaaauuu

SEQ ID NO: 29937 - RNA, 21 nt, Artificial Sequence
  Description of Artificial Sequence: Synthetic oligonucleotide
ugaaugucugucuuuuaaauu

SEQ ID NO: 29938 - RNA, 21 nt, Artificial Sequence
  Description of Artificial Sequence: Synthetic oligonucleotide
uggaaugucugucuuuuaauu

SEQ ID NO: 29939 - RNA, 21 nt, Artificial Sequence
  Description of Artificial Sequence: Synthetic oligonucleotide
uaggaaugucugucuuuuauu

SEQ ID NO: 29940 - RNA, 21 nt, Artificial Sequence
  Description of Artificial Sequence: Synthetic oligonucleotide
uaaggaaugucugucuuuuuu

SEQ ID NO: 29941 - RNA, 21 nt, Artificial Sequence
  Description of Artificial Sequence: Synthetic oligonucleotide
ugaaggaaugucugucuuuuu

SEQ ID NO: 29942 - RNA, 21 nt, Artificial Sequence
  Description of Artificial Sequence: Synthetic oligonucleotide
uagaaggaaugucugucuuuu

SEQ ID NO: 29943 - RNA, 21 nt, Artificial Sequence
  Description of Artificial Sequence: Synthetic oligonucleotide
uuagaaggaaugucugucuuu

SEQ ID NO: 29944 - RNA, 21 nt, Artificial Sequence
  Description of Artificial Sequence: Synthetic oligonucleotide
uguagaaggaaugucugucuu

SEQ ID NO: 29945 - RNA, 21 nt, Artificial Sequence
  Description of Artificial Sequence: Synthetic oligonucleotide
uuguagaaggaaugucuguuu

SEQ ID NO: 29946 - RNA, 21 nt, Artificial Sequence
  Description of Artificial Sequence: Synthetic oligonucleotide
uauguagaaggaaugucuguu

SEQ ID NO: 29947 - RNA, 21 nt, Artificial Sequence
  Description of Artificial Sequence: Synthetic oligonucleotide
ucauguagaaggaaugucuuu

SEQ ID NO: 29948 - RNA, 21 nt, Artificial Sequence
  Description of Artificial Sequence: Synthetic oligonucleotide
uacauguagaaggaaugucuu

SEQ ID NO: 29949 - RNA, 21 nt, Artificial Sequence
  Description of Artificial Sequence: Synthetic oligonucleotide
uuacauguagaaggaauguuu

SEQ ID NO: 29950 - RNA, 21 nt, Artificial Sequence
  Description of Artificial Sequence: Synthetic oligonucleotide
uuuacauguagaaggaauguu

SEQ ID NO: 29951 - RNA, 21 nt, Artificial Sequence
  Description of Artificial Sequence: Synthetic oligonucleotide
uauuacauguagaaggaauuu

SEQ ID NO: 29952 - RNA, 21 nt, Artificial Sequence
  Description of Artificial Sequence: Synthetic oligonucleotide
ucauuacauguagaaggaauu

SEQ ID NO: 29953 - RNA, 21 nt, Artificial Sequence
  Description of Artificial Sequence: Synthetic oligonucleotide
uucauuacauguagaaggauu

SEQ ID NO: 29954 - RNA, 21 nt, Artificial Sequence
  Description of Artificial Sequence: Synthetic oligonucleotide
ugucauuacauguagaagguu

SEQ ID NO: 29955 - RNA, 21 nt, Artificial Sequence
  Description of Artificial Sequence: Synthetic oligonucleotide
uugucauuacauguagaaguu

SEQ ID NO: 29956 - RNA, 21 nt, Artificial Sequence
  Description of Artificial Sequence: Synthetic oligonucleotide
ugugucauuacauguagaauu

SEQ ID NO: 29957 - RNA, 21 nt, Artificial Sequence
  Description of Artificial Sequence: Synthetic oligonucleotide
uagugucauuacauguagauu

SEQ ID NO: 29958 - RNA, 21 nt, Artificial Sequence
  Description of Artificial Sequence: Synthetic oligonucleotide
uaagugucauuacauguaguu

SEQ ID NO: 29959 - RNA, 21 nt, Artificial Sequence
  Description of Artificial Sequence: Synthetic oligonucleotide
ugaagugucauuacauguauu

SEQ ID NO: 29960 - RNA, 21 nt, Artificial Sequence
  Description of Artificial Sequence: Synthetic oligonucleotide
uagaagugucauuacauguuu

SEQ ID NO: 29961 - RNA, 21 nt, Artificial Sequence
  Description of Artificial Sequence: Synthetic oligonucleotide
uaagaagugucauuacauguu

SEQ ID NO: 29962 - RNA, 21 nt, Artificial Sequence
  Description of Artificial Sequence: Synthetic oligonucleotide
ucaagaagugucauuacauuu

SEQ ID NO: 29963 - RNA, 21 nt, Artificial Sequence
  Description of Artificial Sequence: Synthetic oligonucleotide
uacaagaagugucauuacauu

SEQ ID NO: 29964 - RNA, 21 nt, Artificial Sequence
  Description of Artificial Sequence: Synthetic oligonucleotide
ucacaagaagugucauuacuu

SEQ ID NO: 29965 - RNA, 21 nt, Artificial Sequence
  Description of Artificial Sequence: Synthetic oligonucleotide
uacacaagaagugucauuauu

SEQ ID NO: 29966 - RNA, 21 nt, Artificial Sequence
  Description of Artificial Sequence: Synthetic oligonucleotide
uaacacaagaagugucauuuu

SEQ ID NO: 29967 - RNA, 21 nt, Artificial Sequence
  Description of Artificial Sequence: Synthetic oligonucleotide
uuaacacaagaagugucauuu

SEQ ID NO: 29968 - RNA, 21 nt, Artificial Sequence
  Description of Artificial Sequence: Synthetic oligonucleotide
uuuaacacaagaagugucauu

SEQ ID NO: 29969 - RNA, 21 nt, Artificial Sequence
  Description of Artificial Sequence: Synthetic oligonucleotide
uuuuaacacaagaagugucuu

SEQ ID NO: 29970 - RNA, 21 nt, Artificial Sequence
  Description of Artificial Sequence: Synthetic oligonucleotide
uguuuaacacaagaaguguuu

SEQ ID NO: 29971 - RNA, 21 nt, Artificial Sequence
  Description of Artificial Sequence: Synthetic oligonucleotide
uaguuuaacacaagaaguguu

SEQ ID NO: 29972 - RNA, 21 nt, Artificial Sequence
  Description of Artificial Sequence: Synthetic oligonucleotide
uuaguuuaacacaagaaguuu

SEQ ID NO: 29973 - RNA, 21 nt, Artificial Sequence
  Description of Artificial Sequence: Synthetic oligonucleotide
uuuaguuuaacacaagaaguu

SEQ ID NO: 29974 - RNA, 21 nt, Artificial Sequence
  Description of Artificial Sequence: Synthetic oligonucleotide
uuuuaguuuaacacaagaauu

SEQ ID NO: 29975 - RNA, 21 nt, Artificial Sequence
  Description of Artificial Sequence: Synthetic oligonucleotide
uuuuuaguuuaacacaagauu

SEQ ID NO: 29976 - RNA, 21 nt, Artificial Sequence
  Description of Artificial Sequence: Synthetic oligonucleotide
uuuuuuaguuuaacacaaguu

SEQ ID NO: 29977 - RNA, 21 nt, Artificial Sequence
  Description of Artificial Sequence: Synthetic oligonucleotide
uauuuuuaguuuaacacaauu

SEQ ID NO: 29978 - RNA, 21 nt, Artificial Sequence
  Description of Artificial Sequence: Synthetic oligonucleotide
uaauuuuuaguuuaacacauu

SEQ ID NO: 29979 - RNA, 21 nt, Artificial Sequence
  Description of Artificial Sequence: Synthetic oligonucleotide
uaaauuuuuaguuuaacacuu

SEQ ID NO: 29980 - RNA, 21 nt, Artificial Sequence
  Description of Artificial Sequence: Synthetic oligonucleotide
uuaaauuuuuaguuuaacauu

SEQ ID NO: 29981 - RNA, 21 nt, Artificial Sequence
  Description of Artificial Sequence: Synthetic oligonucleotide
uguaaauuuuuaguuuaacuu

SEQ ID NO: 29982 - RNA, 21 nt, Artificial Sequence
  Description of Artificial Sequence: Synthetic oligonucleotide
uuguaaauuuuuaguuuaauu

SEQ ID NO: 29983 - RNA, 21 nt, Artificial Sequence
  Description of Artificial Sequence: Synthetic oligonucleotide
uuuguaaauuuuuaguuuauu

SEQ ID NO: 29984 - RNA, 21 nt, Artificial Sequence
  Description of Artificial Sequence: Synthetic oligonucleotide
ucuuguaaauuuuuaguuuuu

SEQ ID NO: 29985 - RNA, 21 nt, Artificial Sequence
  Description of Artificial Sequence: Synthetic oligonucleotide
uucuuguaaauuuuuaguuuu

SEQ ID NO: 29986 - RNA, 21 nt, Artificial Sequence
  Description of Artificial Sequence: Synthetic oligonucleotide
ucucuuguaaauuuuuaguuu

SEQ ID NO: 29987 - RNA, 21 nt, Artificial Sequence
  Description of Artificial Sequence: Synthetic oligonucleotide
uucucuuguaaauuuuuaguu

SEQ ID NO: 29988 - RNA, 21 nt, Artificial Sequence
  Description of Artificial Sequence: Synthetic oligonucleotide
uuucucuuguaaauuuuuauu

SEQ ID NO: 29989 - RNA, 21 nt, Artificial Sequence
  Description of Artificial Sequence: Synthetic oligonucleotide
ucuucucuuguaaauuuuuuu

SEQ ID NO: 29990 - RNA, 21 nt, Artificial Sequence
  Description of Artificial Sequence: Synthetic oligonucleotide
uucuucucuuguaaauuuuuu

SEQ ID NO: 29991 - RNA, 21 nt, Artificial Sequence
  Description of Artificial Sequence: Synthetic oligonucleotide
uuucuucucuuguaaauuuuu

SEQ ID NO: 29992 - RNA, 21 nt, Artificial Sequence
  Description of Artificial Sequence: Synthetic oligonucleotide
uuuucuucucuuguaaauuuu

SEQ ID NO: 29993 - RNA, 21 nt, Artificial Sequence
  Description of Artificial Sequence: Synthetic oligonucleotide
ucuuucuucucuuguaaauuu

SEQ ID NO: 29994 - RNA, 21 nt, Artificial Sequence
  Description of Artificial Sequence: Synthetic oligonucleotide
uacuuucuucucuuguaaauu

SEQ ID NO: 29995 - RNA, 21 nt, Artificial Sequence
  Description of Artificial Sequence: Synthetic oligonucleotide
ucacuuucuucucuuguaauu

SEQ ID NO: 29996 - RNA, 21 nt, Artificial Sequence
  Description of Artificial Sequence: Synthetic oligonucleotide
uucacuuucuucucuuguauu

SEQ ID NO: 29997 - RNA, 21 nt, Artificial Sequence
  Description of Artificial Sequence: Synthetic oligonucleotide
uuucacuuucuucucuuguuu

SEQ ID NO: 29998 - RNA, 21 nt, Artificial Sequence
  Description of Artificial Sequence: Synthetic oligonucleotide
uuuucacuuucuucucuuguu

SEQ ID NO: 29999 - RNA, 21 nt, Artificial Sequence
  Description of Artificial Sequence: Synthetic oligonucleotide
ucuuucacuuucuucucuuuu

SEQ ID NO: 30000 - RNA, 21 nt, Artificial Sequence
  Description of Artificial Sequence: Synthetic oligonucleotide
ugcuuucacuuucuucucuuu

SEQ ID NO: 30001 - RNA, 21 nt, Artificial Sequence
  Description of Artificial Sequence: Synthetic oligonucleotide
uugcuuucacuuucuucucuu

SEQ ID NO: 30002 - RNA, 21 nt, Artificial Sequence
  Description of Artificial Sequence: Synthetic oligonucleotide
uuugcuuucacuuucuucuuu

SEQ ID NO: 30003 - RNA, 21 nt, Artificial Sequence
  Description of Artificial Sequence: Synthetic oligonucleotide
uuuugcuuucacuuucuucuu

SEQ ID NO: 30004 - RNA, 21 nt, Artificial Sequence
  Description of Artificial Sequence: Synthetic oligonucleotide
uauuugcuuucacuuucuuuu

SEQ ID NO: 30005 - RNA, 21 nt, Artificial Sequence
  Description of Artificial Sequence: Synthetic oligonucleotide
ucauuugcuuucacuuucuuu

SEQ ID NO: 30006 - RNA, 21 nt, Artificial Sequence
  Description of Artificial Sequence: Synthetic oligonucleotide
uccauuugcuuucacuuucuu

SEQ ID NO: 30007 - RNA, 21 nt, Artificial Sequence
  Description of Artificial Sequence: Synthetic oligonucleotide
ucccauuugcuuucacuuuuu

SEQ ID NO: 30008 - RNA, 21 nt, Artificial Sequence
  Description of Artificial Sequence: Synthetic oligonucleotide
uccccauuugcuuucacuuuu

SEQ ID NO: 30009 - RNA, 21 nt, Artificial Sequence
  Description of Artificial Sequence: Synthetic oligonucleotide
uaccccauuugcuuucacuuu

SEQ ID NO: 30010 - RNA, 21 nt, Artificial Sequence
  Description of Artificial Sequence: Synthetic oligonucleotide
uaaccccauuugcuuucacuu

SEQ ID NO: 30011 - RNA, 21 nt, Artificial Sequence
  Description of Artificial Sequence: Synthetic oligonucleotide
uaaaccccauuugcuuucauu

SEQ ID NO: 30012 - RNA, 21 nt, Artificial Sequence
  Description of Artificial Sequence: Synthetic oligonucleotide
ugaaaccccauuugcuuucuu

SEQ ID NO: 30013 - RNA, 21 nt, Artificial Sequence
  Description of Artificial Sequence: Synthetic oligonucleotide
uugaaaccccauuugcuuuuu

SEQ ID NO: 30014 - RNA, 21 nt, Artificial Sequence
  Description of Artificial Sequence: Synthetic oligonucleotide
ugugaaaccccauuugcuuuu

SEQ ID NO: 30015 - RNA, 21 nt, Artificial Sequence
  Description of Artificial Sequence: Synthetic oligonucleotide
uugugaaaccccauuugcuuu

SEQ ID NO: 30016 - RNA, 21 nt, Artificial Sequence
  Description of Artificial Sequence: Synthetic oligonucleotide
uuugugaaaccccauuugcuu

SEQ ID NO: 30017 - RNA, 21 nt, Artificial Sequence
  Description of Artificial Sequence: Synthetic oligonucleotide
uuuugugaaaccccauuuguu

SEQ ID NO: 30018 - RNA, 21 nt, Artificial Sequence
  Description of Artificial Sequence: Synthetic oligonucleotide
uauuugugaaaccccauuuuu

SEQ ID NO: 30019 - RNA, 21 nt, Artificial Sequence
  Description of Artificial Sequence: Synthetic oligonucleotide
uuauuugugaaaccccauuuu

SEQ ID NO: 30020 - RNA, 21 nt, Artificial Sequence
  Description of Artificial Sequence: Synthetic oligonucleotide
ucuauuugugaaaccccauuu

SEQ ID NO: 30021 - RNA, 21 nt, Artificial Sequence
  Description of Artificial Sequence: Synthetic oligonucleotide
uacuauuugugaaaccccauu

SEQ ID NO: 30022 - RNA, 21 nt, Artificial Sequence
  Description of Artificial Sequence: Synthetic oligonucleotide
uaacuauuugugaaaccccuu

SEQ ID NO: 30023 - RNA, 21 nt, Artificial Sequence
  Description of Artificial Sequence: Synthetic oligonucleotide
ucaacuauuugugaaacccuu

SEQ ID NO: 30024 - RNA, 21 nt, Artificial Sequence
  Description of Artificial Sequence: Synthetic oligonucleotide
uacaacuauuugugaaaccuu

SEQ ID NO: 30025 - RNA, 21 nt, Artificial Sequence
  Description of Artificial Sequence: Synthetic oligonucleotide
uuacaacuauuugugaaacuu

SEQ ID NO: 30026 - RNA, 21 nt, Artificial Sequence
  Description of Artificial Sequence: Synthetic oligonucleotide
uuuacaacuauuugugaaauu

SEQ ID NO: 30027 - RNA, 21 nt, Artificial Sequence
  Description of Artificial Sequence: Synthetic oligonucleotide
uuuuacaacuauuugugaauu

SEQ ID NO: 30028 - RNA, 21 nt, Artificial Sequence
  Description of Artificial Sequence: Synthetic oligonucleotide
uauuuacaacuauuugugauu

SEQ ID NO: 30029 - RNA, 21 nt, Artificial Sequence
  Description of Artificial Sequence: Synthetic oligonucleotide
uuauuuacaacuauuuguguu

SEQ ID NO: 30030 - RNA, 21 nt, Artificial Sequence
  Description of Artificial Sequence: Synthetic oligonucleotide
uauauuuacaacuauuuguuu

SEQ ID NO: 30031 - RNA, 21 nt, Artificial Sequence
  Description of Artificial Sequence: Synthetic oligonucleotide
uuauauuuacaacuauuuguu

SEQ ID NO: 30032 - RNA, 21 nt, Artificial Sequence
  Description of Artificial Sequence: Synthetic oligonucleotide
ucuauauuuacaacuauuuuu

SEQ ID NO: 30033 - RNA, 21 nt, Artificial Sequence
  Description of Artificial Sequence: Synthetic oligonucleotide
uacuauauuuacaacuauuuu

SEQ ID NO: 30034 - RNA, 21 nt, Artificial Sequence
  Description of Artificial Sequence: Synthetic oligonucleotide
ucacuauauuuacaacuauuu

SEQ ID NO: 30035 - RNA, 21 nt, Artificial Sequence
  Description of Artificial Sequence: Synthetic oligonucleotide
uucacuauauuuacaacuauu

SEQ ID NO: 30036 - RNA, 21 nt, Artificial Sequence
  Description of Artificial Sequence: Synthetic oligonucleotide
uuucacuauauuuacaacuuu

SEQ ID NO: 30037 - RNA, 21 nt, Artificial Sequence
  Description of Artificial Sequence: Synthetic oligonucleotide
ucuucacuauauuuacaacuu

SEQ ID NO: 30038 - RNA, 21 nt, Artificial Sequence
  Description of Artificial Sequence: Synthetic oligonucleotide
ugcuucacuauauuuacaauu

SEQ ID NO: 30039 - RNA, 21 nt, Artificial Sequence
  Description of Artificial Sequence: Synthetic oligonucleotide
uugcuucacuauauuuacauu

SEQ ID NO: 30040 - RNA, 21 nt, Artificial Sequence
  Description of Artificial Sequence: Synthetic oligonucleotide
uuugcuucacuauauuuacuu

SEQ ID NO: 30041 - RNA, 21 nt, Artificial Sequence
  Description of Artificial Sequence: Synthetic oligonucleotide
uauugcuucacuauauuuauu

SEQ ID NO: 30042 - RNA, 21 nt, Artificial Sequence
  Description of Artificial Sequence: Synthetic oligonucleotide
uaauugcuucacuauauuuuu

SEQ ID NO: 30043 - RNA, 21 nt, Artificial Sequence
  Description of Artificial Sequence: Synthetic oligonucleotide
uaaauugcuucacuauauuuu

SEQ ID NO: 30044 - RNA, 21 nt, Artificial Sequence
  Description of Artificial Sequence: Synthetic oligonucleotide
ucaaauugcuucacuauauuu

SEQ ID NO: 30045 - RNA, 21 nt, Artificial Sequence
  Description of Artificial Sequence: Synthetic oligonucleotide
uucaaauugcuucacuauauu

SEQ ID NO: 30046 - RNA, 21 nt, Artificial Sequence
  Description of Artificial Sequence: Synthetic oligonucleotide
uuucaaauugcuucacuauuu

SEQ ID NO: 30047 - RNA, 21 nt, Artificial Sequence
  Description of Artificial Sequence: Synthetic oligonucleotide
uuuucaaauugcuucacuauu

SEQ ID NO: 30048 - RNA, 21 nt, Artificial Sequence
  Description of Artificial Sequence: Synthetic oligonucleotide
uauuucaaauugcuucacuuu

SEQ ID NO: 30049 - RNA, 21 nt, Artificial Sequence
  Description of Artificial Sequence: Synthetic oligonucleotide
uuauuucaaauugcuucacuu

SEQ ID NO: 30050 - RNA, 21 nt, Artificial Sequence
  Description of Artificial Sequence: Synthetic oligonucleotide
uuuauuucaaauugcuucauu

SEQ ID NO: 30051 - RNA, 21 nt, Artificial Sequence
  Description of Artificial Sequence: Synthetic oligonucleotide
uauuauuucaaauugcuucuu

SEQ ID NO: 30052 - RNA, 21 nt, Artificial Sequence
  Description of Artificial Sequence: Synthetic oligonucleotide
uaauuauuucaaauugcuuuu

SEQ ID NO: 30053 - RNA, 21 nt, Artificial Sequence
  Description of Artificial Sequence: Synthetic oligonucleotide
uaaauuauuucaaauugcuuu

SEQ ID NO: 30054 - RNA, 21 nt, Artificial Sequence
  Description of Artificial Sequence: Synthetic oligonucleotide
uaaaauuauuucaaauugcuu

SEQ ID NO: 30055 - RNA, 21 nt, Artificial Sequence
  Description of Artificial Sequence: Synthetic oligonucleotide
ugaaaauuauuucaaauuguu

SEQ ID NO: 30056 - RNA, 21 nt, Artificial Sequence
  Description of Artificial Sequence: Synthetic oligonucleotide
uugaaaauuauuucaaauuuu

SEQ ID NO: 30057 - RNA, 21 nt, Artificial Sequence
  Description of Artificial Sequence: Synthetic oligonucleotide
uuugaaaauuauuucaaauuu

SEQ ID NO: 30058 - RNA, 21 nt, Artificial Sequence
  Description of Artificial Sequence: Synthetic oligonucleotide
ucuugaaaauuauuucaaauu

SEQ ID NO: 30059 - RNA, 21 nt, Artificial Sequence
  Description of Artificial Sequence: Synthetic oligonucleotide
ugcuugaaaauuauuucaauu

SEQ ID NO: 30060 - RNA, 21 nt, Artificial Sequence
  Description of Artificial Sequence: Synthetic oligonucleotide
uugcuugaaaauuauuucauu

SEQ ID NO: 30061 - RNA, 21 nt, Artificial Sequence
  Description of Artificial Sequence: Synthetic oligonucleotide
uuugcuugaaaauuauuucuu

SEQ ID NO: 30062 - RNA, 21 nt, Artificial Sequence
  Description of Artificial Sequence: Synthetic oligonucleotide
uuuugcuugaaaauuauuuuu

SEQ ID NO: 30063 - RNA, 21 nt, Artificial Sequence
  Description of Artificial Sequence: Synthetic oligonucleotide
ucuuugcuugaaaauuauuuu

SEQ ID NO: 30064 - RNA, 21 nt, Artificial Sequence
  Description of Artificial Sequence: Synthetic oligonucleotide
uacuuugcuugaaaauuauuu

SEQ ID NO: 30065 - RNA, 21 nt, Artificial Sequence
  Description of Artificial Sequence: Synthetic oligonucleotide
uuacuuugcuugaaaauuauu

SEQ ID NO: 30066 - RNA, 21 nt, Artificial Sequence
  Description of Artificial Sequence: Synthetic oligonucleotide
uauacuuugcuugaaaauuuu

SEQ ID NO: 30067 - RNA, 21 nt, Artificial Sequence
  Description of Artificial Sequence: Synthetic oligonucleotide
uaauacuuugcuugaaaauuu

SEQ ID NO: 30068 - RNA, 21 nt, Artificial Sequence
  Description of Artificial Sequence: Synthetic oligonucleotide
ucaauacuuugcuugaaaauu

SEQ ID NO: 30069 - RNA, 21 nt, Artificial Sequence
  Description of Artificial Sequence: Synthetic oligonucleotide
uacaauacuuugcuugaaauu

SEQ ID NO: 30070 - RNA, 21 nt, Artificial Sequence
  Description of Artificial Sequence: Synthetic oligonucleotide
ucacaauacuuugcuugaauu

SEQ ID NO: 30071 - RNA, 21 nt, Artificial Sequence
  Description of Artificial Sequence: Synthetic oligonucleotide
uucacaauacuuugcuugauu

SEQ ID NO: 30072 - RNA, 21 nt, Artificial Sequence
  Description of Artificial Sequence: Synthetic oligonucleotide
uuucacaauacuuugcuuguu

SEQ ID NO: 30073 - RNA, 21 nt, Artificial Sequence
  Description of Artificial Sequence: Synthetic oligonucleotide
uuuucacaauacuuugcuuuu

SEQ ID NO: 30074 - RNA, 21 nt, Artificial Sequence
  Description of Artificial Sequence: Synthetic oligonucleotide
ucuuucacaauacuuugcuuu

SEQ ID NO: 30075 - RNA, 21 nt, Artificial Sequence
  Description of Artificial Sequence: Synthetic oligonucleotide
uacuuucacaauacuuugcuu

SEQ ID NO: 30076 - RNA, 21 nt, Artificial Sequence
  Description of Artificial Sequence: Synthetic oligonucleotide
uuacuuucacaauacuuuguu

SEQ ID NO: 30077 - RNA, 21 nt, Artificial Sequence
  Description of Artificial Sequence: Synthetic oligonucleotide
uauacuuucacaauacuuuuu

SEQ ID NO: 30078 - RNA, 21 nt, Artificial Sequence
  Description of Artificial Sequence: Synthetic oligonucleotide
uaauacuuucacaauacuuuu

SEQ ID NO: 30079 - RNA, 21 nt, Artificial Sequence
  Description of Artificial Sequence: Synthetic oligonucleotide
ugaauacuuucacaauacuuu

SEQ ID NO: 30080 - RNA, 21 nt, Artificial Sequence
  Description of Artificial Sequence: Synthetic oligonucleotide
uagaauacuuucacaauacuu

SEQ ID NO: 30081 - RNA, 21 nt, Artificial Sequence
  Description of Artificial Sequence: Synthetic oligonucleotide
uuagaauacuuucacaauauu

SEQ ID NO: 30082 - RNA, 21 nt, Artificial Sequence
  Description of Artificial Sequence: Synthetic oligonucleotide
uuuagaauacuuucacaauuu

SEQ ID NO: 30083 - RNA, 21 nt, Artificial Sequence
  Description of Artificial Sequence: Synthetic oligonucleotide
ucuuagaauacuuucacaauu

SEQ ID NO: 30084 - RNA, 21 nt, Artificial Sequence
  Description of Artificial Sequence: Synthetic oligonucleotide
ugcuuagaauacuuucacauu

SEQ ID NO: 30085 - RNA, 21 nt, Artificial Sequence
  Description of Artificial Sequence: Synthetic oligonucleotide
uggcuuagaauacuuucacuu

SEQ ID NO: 30086 - RNA, 21 nt, Artificial Sequence
  Description of Artificial Sequence: Synthetic oligonucleotide
uuggcuuagaauacuuucauu

SEQ ID NO: 30087 - RNA, 21 nt, Artificial Sequence
  Description of Artificial Sequence: Synthetic oligonucleotide
uuuggcuuagaauacuuucuu

SEQ ID NO: 30088 - RNA, 21 nt, Artificial Sequence
  Description of Artificial Sequence: Synthetic oligonucleotide
ucuuggcuuagaauacuuuuu

SEQ ID NO: 30089 - RNA, 21 nt, Artificial Sequence
  Description of Artificial Sequence: Synthetic oligonucleotide
uacuuggcuuagaauacuuuu

SEQ ID NO: 30090 - RNA, 21 nt, Artificial Sequence
  Description of Artificial Sequence: Synthetic oligonucleotide
uaacuuggcuuagaauacuuu

SEQ ID NO: 30091 - RNA, 21 nt, Artificial Sequence
  Description of Artificial Sequence: Synthetic oligonucleotide
uaaacuuggcuuagaauacuu

SEQ ID NO: 30092 - RNA, 21 nt, Artificial Sequence
  Description of Artificial Sequence: Synthetic oligonucleotide
uaaaacuuggcuuagaauauu

SEQ ID NO: 30093 - RNA, 21 nt, Artificial Sequence
  Description of Artificial Sequence: Synthetic oligonucleotide
uuaaaacuuggcuuagaauuu

SEQ ID NO: 30094 - RNA, 21 nt, Artificial Sequence
  Description of Artificial Sequence: Synthetic oligonucleotide
uuuaaaacuuggcuuagaauu

SEQ ID NO: 30095 - RNA, 21 nt, Artificial Sequence
  Description of Artificial Sequence: Synthetic oligonucleotide
uuuuaaaacuuggcuuagauu

SEQ ID NO: 30096 - RNA, 21 nt, Artificial Sequence
  Description of Artificial Sequence: Synthetic oligonucleotide
uauuuaaaacuuggcuuaguu

SEQ ID NO: 30097 - RNA, 21 nt, Artificial Sequence
  Description of Artificial Sequence: Synthetic oligonucleotide
uuauuuaaaacuuggcuuauu

SEQ ID NO: 30098 - RNA, 21 nt, Artificial Sequence
  Description of Artificial Sequence: Synthetic oligonucleotide
uauauuuaaaacuuggcuuuu

SEQ ID NO: 30099 - RNA, 21 nt, Artificial Sequence
  Description of Artificial Sequence: Synthetic oligonucleotide
uaauauuuaaaacuuggcuuu

SEQ ID NO: 30100 - RNA, 21 nt, Artificial Sequence
  Description of Artificial Sequence: Synthetic oligonucleotide
uuaauauuuaaaacuuggcuu

SEQ ID NO: 30101 - RNA, 21 nt, Artificial Sequence
  Description of Artificial Sequence: Synthetic oligonucleotide
uauaauauuuaaaacuugguu

SEQ ID NO: 30102 - RNA, 21 nt, Artificial Sequence
  Description of Artificial Sequence: Synthetic oligonucleotide
ugauaauauuuaaaacuuguu

SEQ ID NO: 30103 - RNA, 21 nt, Artificial Sequence
  Description of Artificial Sequence: Synthetic oligonucleotide
uagauaauauuuaaaacuuuu

SEQ ID NO: 30104 - RNA, 21 nt, Artificial Sequence
  Description of Artificial Sequence: Synthetic oligonucleotide
uuagauaauauuuaaaacuuu

SEQ ID NO: 30105 - RNA, 21 nt, Artificial Sequence
  Description of Artificial Sequence: Synthetic oligonucleotide
uuuagauaauauuuaaaacuu

SEQ ID NO: 30106 - RNA, 21 nt, Artificial Sequence
  Description of Artificial Sequence: Synthetic oligonucleotide
uguuagauaauauuuaaaauu

SEQ ID NO: 30107 - RNA, 21 nt, Artificial Sequence
  Description of Artificial Sequence: Synthetic oligonucleotide
uuguuagauaauauuuaaauu

SEQ ID NO: 30108 - RNA, 21 nt, Artificial Sequence
  Description of Artificial Sequence: Synthetic oligonucleotide
ucuguuagauaauauuuaauu

SEQ ID NO: 30109 - RNA, 21 nt, Artificial Sequence
  Description of Artificial Sequence: Synthetic oligonucleotide
uucuguuagauaauauuuauu

SEQ ID NO: 30110 - RNA, 21 nt, Artificial Sequence
  Description of Artificial Sequence: Synthetic oligonucleotide
ugucuguuagauaauauuuuu

SEQ ID NO: 30111 - RNA, 21 nt, Artificial Sequence
  Description of Artificial Sequence: Synthetic oligonucleotide
uugucuguuagauaauauuuu

SEQ ID NO: 30112 - RNA, 21 nt, Artificial Sequence
  Description of Artificial Sequence: Synthetic oligonucleotide
uuugucuguuagauaauauuu

SEQ ID NO: 30113 - RNA, 21 nt, Artificial Sequence
  Description of Artificial Sequence: Synthetic oligonucleotide
ucuugucuguuagauaauauu

SEQ ID NO: 30114 - RNA, 21 nt, Artificial Sequence
  Description of Artificial Sequence: Synthetic oligonucleotide
uucuugucuguuagauaauuu

SEQ ID NO: 30115 - RNA, 21 nt, Artificial Sequence
  Description of Artificial Sequence: Synthetic oligonucleotide
ucucuugucuguuagauaauu

SEQ ID NO: 30116 - RNA, 21 nt, Artificial Sequence
  Description of Artificial Sequence: Synthetic oligonucleotide
uacucuugucuguuagauauu

SEQ ID NO: 30117 - RNA, 21 nt, Artificial Sequence
  Description of Artificial Sequence: Synthetic oligonucleotide
ucacucuugucuguuagauuu

SEQ ID NO: 30118 - RNA, 21 nt, Artificial Sequence
  Description of Artificial Sequence: Synthetic oligonucleotide
uccacucuugucuguuagauu

SEQ ID NO: 30119 - RNA, 21 nt, Artificial Sequence
  Description of Artificial Sequence: Synthetic oligonucleotide
uaccacucuugucuguuaguu

SEQ ID NO: 30120 - RNA, 21 nt, Artificial Sequence
  Description of Artificial Sequence: Synthetic oligonucleotide
uuaccacucuugucuguuauu

SEQ ID NO: 30121 - RNA, 21 nt, Artificial Sequence
  Description of Artificial Sequence: Synthetic oligonucleotide
uauaccacucuugucuguuuu

SEQ ID NO: 30122 - RNA, 21 nt, Artificial Sequence
  Description of Artificial Sequence: Synthetic oligonucleotide
uuauaccacucuugucuguuu

SEQ ID NO: 30123 - RNA, 21 nt, Artificial Sequence
  Description of Artificial Sequence: Synthetic oligonucleotide
uauauaccacucuugucuguu

SEQ ID NO: 30124 - RNA, 21 nt, Artificial Sequence
  Description of Artificial Sequence: Synthetic oligonucleotide
uuauauaccacucuugucuuu

SEQ ID NO: 30125 - RNA, 21 nt, Artificial Sequence
  Description of Artificial Sequence: Synthetic oligonucleotide
uguauauaccacucuugucuu

SEQ ID NO: 30126 - RNA, 21 nt, Artificial Sequence
  Description of Artificial Sequence: Synthetic oligonucleotide
uuguauauaccacucuuguuu

SEQ ID NO: 30127 - RNA, 21 nt, Artificial Sequence
  Description of Artificial Sequence: Synthetic oligonucleotide
uuuguauauaccacucuuguu

SEQ ID NO: 30128 - RNA, 21 nt, Artificial Sequence
  Description of Artificial Sequence: Synthetic oligonucleotide
ucuuguauauaccacucuuuu

SEQ ID NO: 30129 - RNA, 21 nt, Artificial Sequence
  Description of Artificial Sequence: Synthetic oligonucleotide
uacuuguauauaccacucuuu

SEQ ID NO: 30130 - RNA, 21 nt, Artificial Sequence
  Description of Artificial Sequence: Synthetic oligonucleotide
uuacuuguauauaccacucuu

SEQ ID NO: 30131 - RNA, 21 nt, Artificial Sequence
  Description of Artificial Sequence: Synthetic oligonucleotide
ucuacuuguauauaccacuuu

SEQ ID NO: 30132 - RNA, 21 nt, Artificial Sequence
  Description of Artificial Sequence: Synthetic oligonucleotide
uucuacuuguauauaccacuu

SEQ ID NO: 30133 - RNA, 21 nt, Artificial Sequence
  Description of Artificial Sequence: Synthetic oligonucleotide
uaucuacuuguauauaccauu

SEQ ID NO: 30134 - RNA, 21 nt, Artificial Sequence
  Description of Artificial Sequence: Synthetic oligonucleotide
ugaucuacuuguauauaccuu

SEQ ID NO: 30135 - RNA, 21 nt, Artificial Sequence
  Description of Artificial Sequence: Synthetic oligonucleotide
uggaucuacuuguauauacuu

SEQ ID NO: 30136 - RNA, 21 nt, Artificial Sequence
  Description of Artificial Sequence: Synthetic oligonucleotide
uaggaucuacuuguauauauu

SEQ ID NO: 30137 - RNA, 21 nt, Artificial Sequence
  Description of Artificial Sequence: Synthetic oligonucleotide
ucaggaucuacuuguauauuu

SEQ ID NO: 30138 - RNA, 21 nt, Artificial Sequence
  Description of Artificial Sequence: Synthetic oligonucleotide
uucaggaucuacuuguauauu

SEQ ID NO: 30139 - RNA, 21 nt, Artificial Sequence
  Description of Artificial Sequence: Synthetic oligonucleotide
ucucaggaucuacuuguauuu

SEQ ID NO: 30140 - RNA, 21 nt, Artificial Sequence
  Description of Artificial Sequence: Synthetic oligonucleotide
uucucaggaucuacuuguauu

SEQ ID NO: 30141 - RNA, 21 nt, Artificial Sequence
  Description of Artificial Sequence: Synthetic oligonucleotide
uuucucaggaucuacuuguuu

SEQ ID NO: 30142 - RNA, 21 nt, Artificial Sequence
  Description of Artificial Sequence: Synthetic oligonucleotide
ucuucucaggaucuacuuguu

SEQ ID NO: 30143 - RNA, 21 nt, Artificial Sequence
  Description of Artificial Sequence: Synthetic oligonucleotide
uacuucucaggaucuacuuuu

SEQ ID NO: 30144 - RNA, 21 nt, Artificial Sequence
  Description of Artificial Sequence: Synthetic oligonucleotide
uuacuucucaggaucuacuuu

SEQ ID NO: 30145 - RNA, 21 nt, Artificial Sequence
  Description of Artificial Sequence: Synthetic oligonucleotide
uguacuucucaggaucuacuu

SEQ ID NO: 30146 - RNA, 21 nt, Artificial Sequence
  Description of Artificial Sequence: Synthetic oligonucleotide
ugguacuucucaggaucuauu

SEQ ID NO: 30147 - RNA, 21 nt, Artificial Sequence
  Description of Artificial Sequence: Synthetic oligonucleotide
uagguacuucucaggaucuuu

SEQ ID NO: 30148 - RNA, 21 nt, Artificial Sequence
  Description of Artificial Sequence: Synthetic oligonucleotide
uaagguacuucucaggaucuu

SEQ ID NO: 30149 - RNA, 21 nt, Artificial Sequence
  Description of Artificial Sequence: Synthetic oligonucleotide
uaaagguacuucucaggauuu

SEQ ID NO: 30150 - RNA, 21 nt, Artificial Sequence
  Description of Artificial Sequence: Synthetic oligonucleotide
ucaaagguacuucucaggauu

SEQ ID NO: 30151 - RNA, 21 nt, Artificial Sequence
  Description of Artificial Sequence: Synthetic oligonucleotide
uacaaagguacuucucagguu

SEQ ID NO: 30152 - RNA, 21 nt, Artificial Sequence
  Description of Artificial Sequence: Synthetic oligonucleotide
uaacaaagguacuucucaguu

SEQ ID NO: 30153 - RNA, 21 nt, Artificial Sequence
  Description of Artificial Sequence: Synthetic oligonucleotide
uuaacaaagguacuucucauu

SEQ ID NO: 30154 - RNA, 21 nt, Artificial Sequence
  Description of Artificial Sequence: Synthetic oligonucleotide
uguaacaaagguacuucucuu

SEQ ID NO: 30155 - RNA, 21 nt, Artificial Sequence
  Description of Artificial Sequence: Synthetic oligonucleotide
uuguaacaaagguacuucuuu

SEQ ID NO: 30156 - RNA, 21 nt, Artificial Sequence
  Description of Artificial Sequence: Synthetic oligonucleotide
ucuguaacaaagguacuucuu

SEQ ID NO: 30157 - RNA, 21 nt, Artificial Sequence
  Description of Artificial Sequence: Synthetic oligonucleotide
ugcuguaacaaagguacuuuu

SEQ ID NO: 30158 - RNA, 21 nt, Artificial Sequence
  Description of Artificial Sequence: Synthetic oligonucleotide
uagcuguaacaaagguacuuu

SEQ ID NO: 30159 - RNA, 21 nt, Artificial Sequence
  Description of Artificial Sequence: Synthetic oligonucleotide
uuagcuguaacaaagguacuu

SEQ ID NO: 30160 - RNA, 21 nt, Artificial Sequence
  Description of Artificial Sequence: Synthetic oligonucleotide
uguagcuguaacaaagguauu

SEQ ID NO: 30161 - RNA, 21 nt, Artificial Sequence
  Description of Artificial Sequence: Synthetic oligonucleotide
uaguagcuguaacaaagguuu

SEQ ID NO: 30162 - RNA, 21 nt, Artificial Sequence
  Description of Artificial Sequence: Synthetic oligonucleotide
uuaguagcuguaacaaagguu

SEQ ID NO: 30163 - RNA, 21 nt, Artificial Sequence
  Description of Artificial Sequence: Synthetic oligonucleotide
uauaguagcuguaacaaaguu

SEQ ID NO: 30164 - RNA, 21 nt, Artificial Sequence
  Description of Artificial Sequence: Synthetic oligonucleotide
uuauaguagcuguaacaaauu

SEQ ID NO: 30165 - RNA, 21 nt, Artificial Sequence
  Description of Artificial Sequence: Synthetic oligonucleotide
uuuauaguagcuguaacaauu

SEQ ID NO: 30166 - RNA, 21 nt, Artificial Sequence
  Description of Artificial Sequence: Synthetic oligonucleotide
uuuuauaguagcuguaacauu

SEQ ID NO: 30167 - RNA, 21 nt, Artificial Sequence
  Description of Artificial Sequence: Synthetic oligonucleotide
uauuuauaguagcuguaacuu

SEQ ID NO: 30168 - RNA, 21 nt, Artificial Sequence
  Description of Artificial Sequence: Synthetic oligonucleotide
uuauuuauaguagcuguaauu

SEQ ID NO: 30169 - RNA, 21 nt, Artificial Sequence
  Description of Artificial Sequence: Synthetic oligonucleotide
uauauuuauaguagcuguauu

SEQ ID NO: 30170 - RNA, 21 nt, Artificial Sequence
  Description of Artificial Sequence: Synthetic oligonucleotide
uuauauuuauaguagcuguuu

SEQ ID NO: 30171 - RNA, 21 nt, Artificial Sequence
  Description of Artificial Sequence: Synthetic oligonucleotide
uguauauuuauaguagcuguu

SEQ ID NO: 30172 - RNA, 21 nt, Artificial Sequence
  Description of Artificial Sequence: Synthetic oligonucleotide
uuguauauuuauaguagcuuu

SEQ ID NO: 30173 - RNA, 21 nt, Artificial Sequence
  Description of Artificial Sequence: Synthetic oligonucleotide
uauguauauuuauaguagcuu

SEQ ID NO: 30174 - RNA, 21 nt, Artificial Sequence
  Description of Artificial Sequence: Synthetic oligonucleotide
uuauguauauuuauaguaguu

SEQ ID NO: 30175 - RNA, 21 nt, Artificial Sequence
  Description of Artificial Sequence: Synthetic oligonucleotide
uauauguauauuuauaguauu

SEQ ID NO: 30176 - RNA, 21 nt, Artificial Sequence
  Description of Artificial Sequence: Synthetic oligonucleotide
uuauauguauauuuauaguuu

SEQ ID NO: 30177 - RNA, 21 nt, Artificial Sequence
  Description of Artificial Sequence: Synthetic oligonucleotide
uuuauauguauauuuauaguu

SEQ ID NO: 30178 - RNA, 21 nt, Artificial Sequence
  Description of Artificial Sequence: Synthetic oligonucleotide
uuuuauauguauauuuauauu

SEQ ID NO: 30179 - RNA, 21 nt, Artificial Sequence
  Description of Artificial Sequence: Synthetic oligonucleotide
uauuuauauguauauuuauuu

SEQ ID NO: 30180 - RNA, 21 nt, Artificial Sequence
  Description of Artificial Sequence: Synthetic oligonucleotide
uaauuuauauguauauuuauu

SEQ ID NO: 30181 - RNA, 21 nt, Artificial Sequence
  Description of Artificial Sequence: Synthetic oligonucleotide
uuaauuuauauguauauuuuu

SEQ ID NO: 30182 - RNA, 21 nt, Artificial Sequence
  Description of Artificial Sequence: Synthetic oligonucleotide
uauaauuuauauguauauuuu

SEQ ID NO: 30183 - RNA, 21 nt, Artificial Sequence
  Description of Artificial Sequence: Synthetic oligonucleotide
uuauaauuuauauguauauuu

SEQ ID NO: 30184 - RNA, 21 nt, Artificial Sequence
  Description of Artificial Sequence: Synthetic oligonucleotide
ucuauaauuuauauguauauu

SEQ ID NO: 30185 - RNA, 21 nt, Artificial Sequence
  Description of Artificial Sequence: Synthetic oligonucleotide
uucuauaauuuauauguauuu

SEQ ID NO: 30186 - RNA, 21 nt, Artificial Sequence
  Description of Artificial Sequence: Synthetic oligonucleotide
uuucuauaauuuauauguauu

SEQ ID NO: 30187 - RNA, 21 nt, Artificial Sequence
  Description of Artificial Sequence: Synthetic oligonucleotide
uauucuauaauuuauauguuu

SEQ ID NO: 30188 - RNA, 21 nt, Artificial Sequence
  Description of Artificial Sequence: Synthetic oligonucleotide
ugauucuauaauuuauauguu

SEQ ID NO: 30189 - RNA, 21 nt, Artificial Sequence
  Description of Artificial Sequence: Synthetic oligonucleotide
uagauucuauaauuuauauuu

SEQ ID NO: 30190 - RNA, 21 nt, Artificial Sequence
  Description of Artificial Sequence: Synthetic oligonucleotide
uuagauucuauaauuuauauu

SEQ ID NO: 30191 - RNA, 21 nt, Artificial Sequence
  Description of Artificial Sequence: Synthetic oligonucleotide
uguagauucuauaauuuauuu

SEQ ID NO: 30192 - RNA, 21 nt, Artificial Sequence
  Description of Artificial Sequence: Synthetic oligonucleotide
uaguagauucuauaauuuauu

SEQ ID NO: 30193 - RNA, 21 nt, Artificial Sequence
  Description of Artificial Sequence: Synthetic oligonucleotide
uaaguagauucuauaauuuuu

SEQ ID NO: 30194 - RNA, 21 nt, Artificial Sequence
  Description of Artificial Sequence: Synthetic oligonucleotide
uaaaguagauucuauaauuuu

SEQ ID NO: 30195 - RNA, 21 nt, Artificial Sequence
  Description of Artificial Sequence: Synthetic oligonucleotide
uuaaaguagauucuauaauuu

SEQ ID NO: 30196 - RNA, 21 nt, Artificial Sequence
  Description of Artificial Sequence: Synthetic oligonucleotide
uuuaaaguagauucuauaauu

SEQ ID NO: 30197 - RNA, 21 nt, Artificial Sequence
  Description of Artificial Sequence: Synthetic oligonucleotide
uauuaaaguagauucuauauu

SEQ ID NO: 30198 - RNA, 21 nt, Artificial Sequence
  Description of Artificial Sequence: Synthetic oligonucleotide
uaauuaaaguagauucuauuu

SEQ ID NO: 30199 - RNA, 21 nt, Artificial Sequence
  Description of Artificial Sequence: Synthetic oligonucleotide
uaaauuaaaguagauucuauu

SEQ ID NO: 30200 - RNA, 21 nt, Artificial Sequence
  Description of Artificial Sequence: Synthetic oligonucleotide
uuaaauuaaaguagauucuuu

SEQ ID NO: 30201 - RNA, 21 nt, Artificial Sequence
  Description of Artificial Sequence: Synthetic oligonucleotide
uauaaauuaaaguagauucuu

SEQ ID NO: 30202 - RNA, 21 nt, Artificial Sequence
  Description of Artificial Sequence: Synthetic oligonucleotide
uaauaaauuaaaguagauuuu

SEQ ID NO: 30203 - RNA, 21 nt, Artificial Sequence
  Description of Artificial Sequence: Synthetic oligonucleotide
uaaauaaauuaaaguagauuu

SEQ ID NO: 30204 - RNA, 21 nt, Artificial Sequence
  Description of Artificial Sequence: Synthetic oligonucleotide
uaaaauaaauuaaaguagauu

SEQ ID NO: 30205 - RNA, 21 nt, Artificial Sequence
  Description of Artificial Sequence: Synthetic oligonucleotide
ucaaaauaaauuaaaguaguu

SEQ ID NO: 30206 - RNA, 21 nt, Artificial Sequence
  Description of Artificial Sequence: Synthetic oligonucleotide
uacaaaauaaauuaaaguauu

SEQ ID NO: 30207 - RNA, 21 nt, Artificial Sequence
  Description of Artificial Sequence: Synthetic oligonucleotide
ucacaaaauaaauuaaaguuu

SEQ ID NO: 30208 - RNA, 21 nt, Artificial Sequence
  Description of Artificial Sequence: Synthetic oligonucleotide
uucacaaaauaaauuaaaguu

SEQ ID NO: 30209 - RNA, 21 nt, Artificial Sequence
  Description of Artificial Sequence: Synthetic oligonucleotide
uuucacaaaauaaauuaaauu

SEQ ID NO: 30210 - RNA, 21 nt, Artificial Sequence
  Description of Artificial Sequence: Synthetic oligonucleotide
uguucacaaaauaaauuaauu

SEQ ID NO: 30211 - RNA, 21 nt, Artificial Sequence
  Description of Artificial Sequence: Synthetic oligonucleotide
uuguucacaaaauaaauuauu

SEQ ID NO: 30212 - RNA, 21 nt, Artificial Sequence
  Description of Artificial Sequence: Synthetic oligonucleotide
uguguucacaaaauaaauuuu

SEQ ID NO: 30213 - RNA, 21 nt, Artificial Sequence
  Description of Artificial Sequence: Synthetic oligonucleotide
uaguguucacaaaauaaauuu

SEQ ID NO: 30214 - RNA, 21 nt, Artificial Sequence
  Description of Artificial Sequence: Synthetic oligonucleotide
uaaguguucacaaaauaaauu

SEQ ID NO: 30215 - RNA, 21 nt, Artificial Sequence
  Description of Artificial Sequence: Synthetic oligonucleotide
uaaaguguucacaaaauaauu

SEQ ID NO: 30216 - RNA, 21 nt, Artificial Sequence
  Description of Artificial Sequence: Synthetic oligonucleotide
uaaaaguguucacaaaauauu

SEQ ID NO: 30217 - RNA, 21 nt, Artificial Sequence
  Description of Artificial Sequence: Synthetic oligonucleotide
ucaaaaguguucacaaaauuu

SEQ ID NO: 30218 - RNA, 21 nt, Artificial Sequence
  Description of Artificial Sequence: Synthetic oligonucleotide
uucaaaaguguucacaaaauu

SEQ ID NO: 30219 - RNA, 21 nt, Artificial Sequence
  Description of Artificial Sequence: Synthetic oligonucleotide
uuucaaaaguguucacaaauu

SEQ ID NO: 30220 - RNA, 21 nt, Artificial Sequence
  Description of Artificial Sequence: Synthetic oligonucleotide
uuuucaaaaguguucacaauu

SEQ ID NO: 30221 - RNA, 21 nt, Artificial Sequence
  Description of Artificial Sequence: Synthetic oligonucleotide
uuuuucaaaaguguucacauu

SEQ ID NO: 30222 - RNA, 21 nt, Artificial Sequence
  Description of Artificial Sequence: Synthetic oligonucleotide
uauuuucaaaaguguucacuu

SEQ ID NO: 30223 - RNA, 21 nt, Artificial Sequence
  Description of Artificial Sequence: Synthetic oligonucleotide
ucauuuucaaaaguguucauu

SEQ ID NO: 30224 - RNA, 21 nt, Artificial Sequence
  Description of Artificial Sequence: Synthetic oligonucleotide
uacauuuucaaaaguguucuu

SEQ ID NO: 30225 - RNA, 21 nt, Artificial Sequence
  Description of Artificial Sequence: Synthetic oligonucleotide
uuacauuuucaaaaguguuuu

SEQ ID NO: 30226 - RNA, 21 nt, Artificial Sequence
  Description of Artificial Sequence: Synthetic oligonucleotide
uguacauuuucaaaaguguuu

SEQ ID NO: 30227 - RNA, 21 nt, Artificial Sequence
  Description of Artificial Sequence: Synthetic oligonucleotide
uuguacauuuucaaaaguguu

SEQ ID NO: 30228 - RNA, 21 nt, Artificial Sequence
  Description of Artificial Sequence: Synthetic oligonucleotide
uauguacauuuucaaaaguuu

SEQ ID NO: 30229 - RNA, 21 nt, Artificial Sequence
  Description of Artificial Sequence: Synthetic oligonucleotide
ucauguacauuuucaaaaguu

SEQ ID NO: 30230 - RNA, 21 nt, Artificial Sequence
  Description of Artificial Sequence: Synthetic oligonucleotide
uacauguacauuuucaaaauu

SEQ ID NO: 30231 - RNA, 21 nt, Artificial Sequence
  Description of Artificial Sequence: Synthetic oligonucleotide
uaacauguacauuuucaaauu

SEQ ID NO: 30232 - RNA, 21 nt, Artificial Sequence
  Description of Artificial Sequence: Synthetic oligonucleotide
ugaacauguacauuuucaauu

SEQ ID NO: 30233 - RNA, 21 nt, Artificial Sequence
  Description of Artificial Sequence: Synthetic oligonucleotide
uggaacauguacauuuucauu

SEQ ID NO: 30234 - RNA, 21 nt, Artificial Sequence
  Description of Artificial Sequence: Synthetic oligonucleotide
uaggaacauguacauuuucuu

SEQ ID NO: 30235 - RNA, 21 nt, Artificial Sequence
  Description of Artificial Sequence: Synthetic oligonucleotide
uaaggaacauguacauuuuuu

SEQ ID NO: 30236 - RNA, 21 nt, Artificial Sequence
  Description of Artificial Sequence: Synthetic oligonucleotide
uaaaggaacauguacauuuuu

SEQ ID NO: 30237 - RNA, 21 nt, Artificial Sequence
  Description of Artificial Sequence: Synthetic oligonucleotide
ucaaaggaacauguacauuuu

SEQ ID NO: 30238 - RNA, 21 nt, Artificial Sequence
  Description of Artificial Sequence: Synthetic oligonucleotide
uacaaaggaacauguacauuu

SEQ ID NO: 30239 - RNA, 21 nt, Artificial Sequence
  Description of Artificial Sequence: Synthetic oligonucleotide
uuacaaaggaacauguacauu

SEQ ID NO: 30240 - RNA, 21 nt, Artificial Sequence
  Description of Artificial Sequence: Synthetic oligonucleotide
uuuacaaaggaacauguacuu

SEQ ID NO: 30241 - RNA, 21 nt, Artificial Sequence
  Description of Artificial Sequence: Synthetic oligonucleotide
uauuacaaaggaacauguauu

SEQ ID NO: 30242 - RNA, 21 nt, Artificial Sequence
  Description of Artificial Sequence: Synthetic oligonucleotide
uaauuacaaaggaacauguuu

SEQ ID NO: 30243 - RNA, 21 nt, Artificial Sequence
  Description of Artificial Sequence: Synthetic oligonucleotide
ucaauuacaaaggaacauguu

SEQ ID NO: 30244 - RNA, 21 nt, Artificial Sequence
  Description of Artificial Sequence: Synthetic oligonucleotide
uucaauuacaaaggaacauuu

SEQ ID NO: 30245 - RNA, 21 nt, Artificial Sequence
  Description of Artificial Sequence: Synthetic oligonucleotide
ugucaauuacaaaggaacauu

SEQ ID NO: 30246 - RNA, 21 nt, Artificial Sequence
  Description of Artificial Sequence: Synthetic oligonucleotide
uugucaauuacaaaggaacuu

SEQ ID NO: 30247 - RNA, 21 nt, Artificial Sequence
  Description of Artificial Sequence: Synthetic oligonucleotide
ugugucaauuacaaaggaauu

SEQ ID NO: 30248 - RNA, 21 nt, Artificial Sequence
  Description of Artificial Sequence: Synthetic oligonucleotide
uagugucaauuacaaaggauu

SEQ ID NO: 30249 - RNA, 21 nt, Artificial Sequence
  Description of Artificial Sequence: Synthetic oligonucleotide
uuagugucaauuacaaagguu

SEQ ID NO: 30250 - RNA, 21 nt, Artificial Sequence
  Description of Artificial Sequence: Synthetic oligonucleotide
uauagugucaauuacaaaguu

SEQ ID NO: 30251 - RNA, 21 nt, Artificial Sequence
  Description of Artificial Sequence: Synthetic oligonucleotide
uuauagugucaauuacaaauu

SEQ ID NO: 30252 - RNA, 21 nt, Artificial Sequence
  Description of Artificial Sequence: Synthetic oligonucleotide
uauauagugucaauuacaauu

SEQ ID NO: 30253 - RNA, 21 nt, Artificial Sequence
  Description of Artificial Sequence: Synthetic oligonucleotide
uuauauagugucaauuacauu

SEQ ID NO: 30254 - RNA, 21 nt, Artificial Sequence
  Description of Artificial Sequence: Synthetic oligonucleotide
uauauauagugucaauuacuu

SEQ ID NO: 30255 - RNA, 21 nt, Artificial Sequence
  Description of Artificial Sequence: Synthetic oligonucleotide
uaauauauagugucaauuauu

SEQ ID NO: 30256 - RNA, 21 nt, Artificial Sequence
  Description of Artificial Sequence: Synthetic oligonucleotide
uaaauauauagugucaauuuu

SEQ ID NO: 30257 - RNA, 21 nt, Artificial Sequence
  Description of Artificial Sequence: Synthetic oligonucleotide
ugaaauauauagugucaauuu

SEQ ID NO: 30258 - RNA, 21 nt, Artificial Sequence
  Description of Artificial Sequence: Synthetic oligonucleotide
uagaaauauauagugucaauu

SEQ ID NO: 30259 - RNA, 21 nt, Artificial Sequence
  Description of Artificial Sequence: Synthetic oligonucleotide
uaagaaauauauagugucauu

SEQ ID NO: 30260 - RNA, 21 nt, Artificial Sequence
  Description of Artificial Sequence: Synthetic oligonucleotide
uuaagaaauauauagugucuu

SEQ ID NO: 30261 - RNA, 21 nt, Artificial Sequence
  Description of Artificial Sequence: Synthetic oligonucleotide
uuuaagaaauauauaguguuu

SEQ ID NO: 30262 - RNA, 21 nt, Artificial Sequence
  Description of Artificial Sequence: Synthetic oligonucleotide
uauuaagaaauauauaguguu

SEQ ID NO: 30263 - RNA, 21 nt, Artificial Sequence
  Description of Artificial Sequence: Synthetic oligonucleotide
uuauuaagaaauauauaguuu

SEQ ID NO: 30264 - RNA, 21 nt, Artificial Sequence
  Description of Artificial Sequence: Synthetic oligonucleotide
uuuauuaagaaauauauaguu

SEQ ID NO: 30265 - RNA, 21 nt, Artificial Sequence
  Description of Artificial Sequence: Synthetic oligonucleotide
uuuuauuaagaaauauauauu

SEQ ID NO: 30266 - RNA, 21 nt, Artificial Sequence
  Description of Artificial Sequence: Synthetic oligonucleotide
uuuuuauuaagaaauauauuu

SEQ ID NO: 30267 - RNA, 21 nt, Artificial Sequence
  Description of Artificial Sequence: Synthetic oligonucleotide
uauuuuauuaagaaauauauu

SEQ ID NO: 30268 - RNA, 21 nt, Artificial Sequence
  Description of Artificial Sequence: Synthetic oligonucleotide
uuauuuuauuaagaaauauuu

SEQ ID NO: 30269 - RNA, 21 nt, Artificial Sequence
  Description of Artificial Sequence: Synthetic oligonucleotide
uuuauuuuauuaagaaauauu

SEQ ID NO: 30270 - RNA, 21 nt, Artificial Sequence
  Description of Artificial Sequence: Synthetic oligonucleotide
uauuauuuuauuaagaaauuu

SEQ ID NO: 30271 - RNA, 21 nt, Artificial Sequence
  Description of Artificial Sequence: Synthetic oligonucleotide
uaauuauuuuauuaagaaauu

SEQ ID NO: 30272 - RNA, 21 nt, Artificial Sequence
  Description of Artificial Sequence: Synthetic oligonucleotide
ugaauuauuuuauuaagaauu

SEQ ID NO: 30273 - RNA, 21 nt, Artificial Sequence
  Description of Artificial Sequence: Synthetic oligonucleotide
uagaauuauuuuauuaagauu

SEQ ID NO: 30274 - RNA, 21 nt, Artificial Sequence
  Description of Artificial Sequence: Synthetic oligonucleotide
ugagaauuauuuuauuaaguu

SEQ ID NO: 30275 - RNA, 21 nt, Artificial Sequence
  Description of Artificial Sequence: Synthetic oligonucleotide
uugagaauuauuuuauuaauu

SEQ ID NO: 30276 - RNA, 21 nt, Artificial Sequence
  Description of Artificial Sequence: Synthetic oligonucleotide
uuugagaauuauuuuauuauu

SEQ ID NO: 30277 - RNA, 21 nt, Artificial Sequence
  Description of Artificial Sequence: Synthetic oligonucleotide
uuuugagaauuauuuuauuuu

SEQ ID NO: 30278 - RNA, 21 nt, Artificial Sequence
  Description of Artificial Sequence: Synthetic oligonucleotide
uauuugagaauuauuuuauuu

SEQ ID NO: 30279 - RNA, 21 nt, Artificial Sequence
  Description of Artificial Sequence: Synthetic oligonucleotide
uaauuugagaauuauuuuauu

SEQ ID NO: 30280 - RNA, 21 nt, Artificial Sequence
  Description of Artificial Sequence: Synthetic oligonucleotide
uaaauuugagaauuauuuuuu

SEQ ID NO: 30281 - RNA, 21 nt, Artificial Sequence
  Description of Artificial Sequence: Synthetic oligonucleotide
ucaaauuugagaauuauuuuu

SEQ ID NO: 30282 - RNA, 21 nt, Artificial Sequence
  Description of Artificial Sequence: Synthetic oligonucleotide
uacaaauuugagaauuauuuu

SEQ ID NO: 30283 - RNA, 21 nt, Artificial Sequence
  Description of Artificial Sequence: Synthetic oligonucleotide
uaacaaauuugagaauuauuu

SEQ ID NO: 30284 - RNA, 21 nt, Artificial Sequence
  Description of Artificial Sequence: Synthetic oligonucleotide
uaaacaaauuugagaauuauu

SEQ ID NO: 30285 - RNA, 21 nt, Artificial Sequence
  Description of Artificial Sequence: Synthetic oligonucleotide
ugaaacaaauuugagaauuuu

SEQ ID NO: 30286 - RNA, 21 nt, Artificial Sequence
  Description of Artificial Sequence: Synthetic oligonucleotide
uagaaacaaauuugagaauuu

SEQ ID NO: 30287 - RNA, 21 nt, Artificial Sequence
  Description of Artificial Sequence: Synthetic oligonucleotide
uaagaaacaaauuugagaauu

SEQ ID NO: 30288 - RNA, 21 nt, Artificial Sequence
  Description of Artificial Sequence: Synthetic oligonucleotide
uuaagaaacaaauuugagauu

SEQ ID NO: 30289 - RNA, 21 nt, Artificial Sequence
  Description of Artificial Sequence: Synthetic oligonucleotide
uauaagaaacaaauuugaguu

SEQ ID NO: 30290 - RNA, 21 nt, Artificial Sequence
  Description of Artificial Sequence: Synthetic oligonucleotide
ucauaagaaacaaauuugauu

SEQ ID NO: 30291 - RNA, 21 nt, Artificial Sequence
  Description of Artificial Sequence: Synthetic oligonucleotide
uucauaagaaacaaauuuguu

SEQ ID NO: 30292 - RNA, 21 nt, Artificial Sequence
  Description of Artificial Sequence: Synthetic oligonucleotide
uuucauaagaaacaaauuuuu

SEQ ID NO: 30293 - RNA, 21 nt, Artificial Sequence
  Description of Artificial Sequence: Synthetic oligonucleotide
uauucauaagaaacaaauuuu

SEQ ID NO: 30294 - RNA, 21 nt, Artificial Sequence
  Description of Artificial Sequence: Synthetic oligonucleotide
ugauucauaagaaacaaauuu

SEQ ID NO: 30295 - RNA, 21 nt, Artificial Sequence
  Description of Artificial Sequence: Synthetic oligonucleotide
uugauucauaagaaacaaauu

SEQ ID NO: 30296 - RNA, 21 nt, Artificial Sequence
  Description of Artificial Sequence: Synthetic oligonucleotide
uaugauucauaagaaacaauu

SEQ ID NO: 30297 - RNA, 21 nt, Artificial Sequence
  Description of Artificial Sequence: Synthetic oligonucleotide
ugaugauucauaagaaacauu

SEQ ID NO: 30298 - RNA, 21 nt, Artificial Sequence
  Description of Artificial Sequence: Synthetic oligonucleotide
uagaugauucauaagaaacuu

SEQ ID NO: 30299 - RNA, 21 nt, Artificial Sequence
  Description of Artificial Sequence: Synthetic oligonucleotide
ugagaugauucauaagaaauu

SEQ ID NO: 30300 - RNA, 21 nt, Artificial Sequence
  Description of Artificial Sequence: Synthetic oligonucleotide
uagagaugauucauaagaauu

SEQ ID NO: 30301 - RNA, 21 nt, Artificial Sequence
  Description of Artificial Sequence: Synthetic oligonucleotide
ugagagaugauucauaagauu

SEQ ID NO: 30302 - RNA, 21 nt, Artificial Sequence
  Description of Artificial Sequence: Synthetic oligonucleotide
uugagagaugauucauaaguu

SEQ ID NO: 30303 - RNA, 21 nt, Artificial Sequence
  Description of Artificial Sequence: Synthetic oligonucleotide
uuugagagaugauucauaauu

SEQ ID NO: 30304 - RNA, 21 nt, Artificial Sequence
  Description of Artificial Sequence: Synthetic oligonucleotide
uuuugagagaugauucauauu

SEQ ID NO: 30305 - RNA, 21 nt, Artificial Sequence
  Description of Artificial Sequence: Synthetic oligonucleotide
uauuugagagaugauucauuu

SEQ ID NO: 30306 - RNA, 21 nt, Artificial Sequence
  Description of Artificial Sequence: Synthetic oligonucleotide
ugauuugagagaugauucauu

SEQ ID NO: 30307 - RNA, 21 nt, Artificial Sequence
  Description of Artificial Sequence: Synthetic oligonucleotide
uagauuugagagaugauucuu

SEQ ID NO: 30308 - RNA, 21 nt, Artificial Sequence
  Description of Artificial Sequence: Synthetic oligonucleotide
uuagauuugagagaugauuuu

SEQ ID NO: 30309 - RNA, 21 nt, Artificial Sequence
  Description of Artificial Sequence: Synthetic oligonucleotide
ucuagauuugagagaugauuu

SEQ ID NO: 30310 - RNA, 21 nt, Artificial Sequence
  Description of Artificial Sequence: Synthetic oligonucleotide
uacuagauuugagagaugauu

SEQ ID NO: 30311 - RNA, 21 nt, Artificial Sequence
  Description of Artificial Sequence: Synthetic oligonucleotide
uaacuagauuugagagauguu

SEQ ID NO: 30312 - RNA, 21 nt, Artificial Sequence
  Description of Artificial Sequence: Synthetic oligonucleotide
uuaacuagauuugagagauuu

SEQ ID NO: 30313 - RNA, 21 nt, Artificial Sequence
  Description of Artificial Sequence: Synthetic oligonucleotide
ucuaacuagauuugagagauu

SEQ ID NO: 30314 - RNA, 21 nt, Artificial Sequence
  Description of Artificial Sequence: Synthetic oligonucleotide
uucuaacuagauuugagaguu

SEQ ID NO: 30315 - RNA, 21 nt, Artificial Sequence
  Description of Artificial Sequence: Synthetic oligonucleotide
ugucuaacuagauuugagauu

SEQ ID NO: 30316 - RNA, 21 nt, Artificial Sequence
  Description of Artificial Sequence: Synthetic oligonucleotide
uugucuaacuagauuugaguu

SEQ ID NO: 30317 - RNA, 21 nt, Artificial Sequence
  Description of Artificial Sequence: Synthetic oligonucleotide
uuugucuaacuagauuugauu

SEQ ID NO: 30318 - RNA, 21 nt, Artificial Sequence
  Description of Artificial Sequence: Synthetic oligonucleotide
uauugucuaacuagauuuguu

SEQ ID NO: 30319 - RNA, 21 nt, Artificial Sequence
  Description of Artificial Sequence: Synthetic oligonucleotide
uaauugucuaacuagauuuuu

SEQ ID NO: 30320 - RNA, 21 nt, Artificial Sequence
  Description of Artificial Sequence: Synthetic oligonucleotide
uaaauugucuaacuagauuuu

SEQ ID NO: 30321 - RNA, 21 nt, Artificial Sequence
  Description of Artificial Sequence: Synthetic oligonucleotide
ucaaauugucuaacuagauuu

SEQ ID NO: 30322 - RNA, 21 nt, Artificial Sequence
  Description of Artificial Sequence: Synthetic oligonucleotide
ugcaaauugucuaacuagauu

SEQ ID NO: 30323 - RNA, 21 nt, Artificial Sequence
  Description of Artificial Sequence: Synthetic oligonucleotide
uugcaaauugucuaacuaguu

SEQ ID NO: 30324 - RNA, 21 nt, Artificial Sequence
  Description of Artificial Sequence: Synthetic oligonucleotide
ugugcaaauugucuaacuauu

SEQ ID NO: 30325 - RNA, 21 nt, Artificial Sequence
  Description of Artificial Sequence: Synthetic oligonucleotide
uugugcaaauugucuaacuuu

SEQ ID NO: 30326 - RNA, 21 nt, Artificial Sequence
  Description of Artificial Sequence: Synthetic oligonucleotide
ugugugcaaauugucuaacuu

SEQ ID NO: 30327 - RNA, 21 nt, Artificial Sequence
  Description of Artificial Sequence: Synthetic oligonucleotide
uugugugcaaauugucuaauu

SEQ ID NO: 30328 - RNA, 21 nt, Artificial Sequence
  Description of Artificial Sequence: Synthetic oligonucleotide
uaugugugcaaauugucuauu

SEQ ID NO: 30329 - RNA, 21 nt, Artificial Sequence
  Description of Artificial Sequence: Synthetic oligonucleotide
uuaugugugcaaauugucuuu

SEQ ID NO: 30330 - RNA, 21 nt, Artificial Sequence
  Description of Artificial Sequence: Synthetic oligonucleotide
uguaugugugcaaauugucuu

SEQ ID NO: 30331 - RNA, 21 nt, Artificial Sequence
  Description of Artificial Sequence: Synthetic oligonucleotide
uaguaugugugcaaauuguuu

SEQ ID NO: 30332 - RNA, 21 nt, Artificial Sequence
  Description of Artificial Sequence: Synthetic oligonucleotide
uaaguaugugugcaaauuguu

SEQ ID NO: 30333 - RNA, 21 nt, Artificial Sequence
  Description of Artificial Sequence: Synthetic oligonucleotide
uaaaguaugugugcaaauuuu

SEQ ID NO: 30334 - RNA, 21 nt, Artificial Sequence
  Description of Artificial Sequence: Synthetic oligonucleotide
uaaaaguaugugugcaaauuu

SEQ ID NO: 30335 - RNA, 21 nt, Artificial Sequence
  Description of Artificial Sequence: Synthetic oligonucleotide
ugaaaaguaugugugcaaauu

SEQ ID NO: 30336 - RNA, 21 nt, Artificial Sequence
  Description of Artificial Sequence: Synthetic oligonucleotide
uagaaaaguaugugugcaauu

SEQ ID NO: 30337 - RNA, 21 nt, Artificial Sequence
  Description of Artificial Sequence: Synthetic oligonucleotide
uuagaaaaguaugugugcauu

SEQ ID NO: 30338 - RNA, 21 nt, Artificial Sequence
  Description of Artificial Sequence: Synthetic oligonucleotide
uuuagaaaaguaugugugcuu

SEQ ID NO: 30339 - RNA, 21 nt, Artificial Sequence
  Description of Artificial Sequence: Synthetic oligonucleotide
ucuuagaaaaguauguguguu

SEQ ID NO: 30340 - RNA, 21 nt, Artificial Sequence
  Description of Artificial Sequence: Synthetic oligonucleotide
uccuuagaaaaguauguguuu

SEQ ID NO: 30341 - RNA, 21 nt, Artificial Sequence
  Description of Artificial Sequence: Synthetic oligonucleotide
ucccuuagaaaaguauguguu

SEQ ID NO: 30342 - RNA, 21 nt, Artificial Sequence
  Description of Artificial Sequence: Synthetic oligonucleotide
uucccuuagaaaaguauguuu

SEQ ID NO: 30343 - RNA, 21 nt, Artificial Sequence
  Description of Artificial Sequence: Synthetic oligonucleotide
ugucccuuagaaaaguauguu

SEQ ID NO: 30344 - RNA, 21 nt, Artificial Sequence
  Description of Artificial Sequence: Synthetic oligonucleotide
uugucccuuagaaaaguauuu

SEQ ID NO: 30345 - RNA, 21 nt, Artificial Sequence
  Description of Artificial Sequence: Synthetic oligonucleotide
uaugucccuuagaaaaguauu

SEQ ID NO: 30346 - RNA, 21 nt, Artificial Sequence
  Description of Artificial Sequence: Synthetic oligonucleotide
uaaugucccuuagaaaaguuu

SEQ ID NO: 30347 - RNA, 21 nt, Artificial Sequence
  Description of Artificial Sequence: Synthetic oligonucleotide
uuaaugucccuuagaaaaguu

SEQ ID NO: 30348 - RNA, 21 nt, Artificial Sequence
  Description of Artificial Sequence: Synthetic oligonucleotide
uauaaugucccuuagaaaauu

SEQ ID NO: 30349 - RNA, 21 nt, Artificial Sequence
  Description of Artificial Sequence: Synthetic oligonucleotide
ugauaaugucccuuagaaauu

SEQ ID NO: 30350 - RNA, 21 nt, Artificial Sequence
  Description of Artificial Sequence: Synthetic oligonucleotide
uagauaaugucccuuagaauu

SEQ ID NO: 30351 - RNA, 21 nt, Artificial Sequence
  Description of Artificial Sequence: Synthetic oligonucleotide
uaagauaaugucccuuagauu

SEQ ID NO: 30352 - RNA, 21 nt, Artificial Sequence
  Description of Artificial Sequence: Synthetic oligonucleotide
ugaagauaaugucccuuaguu

SEQ ID NO: 30353 - RNA, 21 nt, Artificial Sequence
  Description of Artificial Sequence: Synthetic oligonucleotide
uggaagauaaugucccuuauu

SEQ ID NO: 30354 - RNA, 21 nt, Artificial Sequence
  Description of Artificial Sequence: Synthetic oligonucleotide
uaggaagauaaugucccuuuu

SEQ ID NO: 30355 - RNA, 21 nt, Artificial Sequence
  Description of Artificial Sequence: Synthetic oligonucleotide
uaaggaagauaaugucccuuu

SEQ ID NO: 30356 - RNA, 21 nt, Artificial Sequence
  Description of Artificial Sequence: Synthetic oligonucleotide
ugaaggaagauaaugucccuu

SEQ ID NO: 30357 - RNA, 21 nt, Artificial Sequence
  Description of Artificial Sequence: Synthetic oligonucleotide
uugaaggaagauaauguccuu

SEQ ID NO: 30358 - RNA, 21 nt, Artificial Sequence
  Description of Artificial Sequence: Synthetic oligonucleotide
ucugaaggaagauaaugucuu

SEQ ID NO: 30359 - RNA, 21 nt, Artificial Sequence
  Description of Artificial Sequence: Synthetic oligonucleotide
uccugaaggaagauaauguuu

SEQ ID NO: 30360 - RNA, 21 nt, Artificial Sequence
  Description of Artificial Sequence: Synthetic oligonucleotide
uaccugaaggaagauaauguu

SEQ ID NO: 30361 - RNA, 21 nt, Artificial Sequence
  Description of Artificial Sequence: Synthetic oligonucleotide
uaaccugaaggaagauaauuu

SEQ ID NO: 30362 - RNA, 21 nt, Artificial Sequence
  Description of Artificial Sequence: Synthetic oligonucleotide
uaaaccugaaggaagauaauu

SEQ ID NO: 30363 - RNA, 21 nt, Artificial Sequence
  Description of Artificial Sequence: Synthetic oligonucleotide
uaaaaccugaaggaagauauu

SEQ ID NO: 30364 - RNA, 21 nt, Artificial Sequence
  Description of Artificial Sequence: Synthetic oligonucleotide
uaaaaaccugaaggaagauuu

SEQ ID NO: 30365 - RNA, 21 nt, Artificial Sequence
  Description of Artificial Sequence: Synthetic oligonucleotide
uuaaaaaccugaaggaagauu

SEQ ID NO: 30366 - RNA, 21 nt, Artificial Sequence
  Description of Artificial Sequence: Synthetic oligonucleotide
uguaaaaaccugaaggaaguu

SEQ ID NO: 30367 - RNA, 21 nt, Artificial Sequence
  Description of Artificial Sequence: Synthetic oligonucleotide
ugguaaaaaccugaaggaauu

SEQ ID NO: 30368 - RNA, 21 nt, Artificial Sequence
  Description of Artificial Sequence: Synthetic oligonucleotide
uagguaaaaaccugaaggauu

SEQ ID NO: 30369 - RNA, 21 nt, Artificial Sequence
  Description of Artificial Sequence: Synthetic oligonucleotide
ugagguaaaaaccugaagguu

SEQ ID NO: 30370 - RNA, 21 nt, Artificial Sequence
  Description of Artificial Sequence: Synthetic oligonucleotide
uggagguaaaaaccugaaguu

SEQ ID NO: 30371 - RNA, 21 nt, Artificial Sequence
  Description of Artificial Sequence: Synthetic oligonucleotide
uuggagguaaaaaccugaauu

SEQ ID NO: 30372 - RNA, 21 nt, Artificial Sequence
  Description of Artificial Sequence: Synthetic oligonucleotide
uguggagguaaaaaccugauu

SEQ ID NO: 30373 - RNA, 21 nt, Artificial Sequence
  Description of Artificial Sequence: Synthetic oligonucleotide
uaguggagguaaaaaccuguu

SEQ ID NO: 30374 - RNA, 21 nt, Artificial Sequence
  Description of Artificial Sequence: Synthetic oligonucleotide
ugaguggagguaaaaaccuuu

SEQ ID NO: 30375 - RNA, 21 nt, Artificial Sequence
  Description of Artificial Sequence: Synthetic oligonucleotide
uugaguggagguaaaaaccuu

SEQ ID NO: 30376 - RNA, 21 nt, Artificial Sequence
  Description of Artificial Sequence: Synthetic oligonucleotide
uaugaguggagguaaaaacuu

SEQ ID NO: 30377 - RNA, 21 nt, Artificial Sequence
  Description of Artificial Sequence: Synthetic oligonucleotide
ugaugaguggagguaaaaauu

SEQ ID NO: 30378 - RNA, 21 nt, Artificial Sequence
  Description of Artificial Sequence: Synthetic oligonucleotide
uggaugaguggagguaaaauu

SEQ ID NO: 30379 - RNA, 21 nt, Artificial Sequence
  Description of Artificial Sequence: Synthetic oligonucleotide
uaggaugaguggagguaaauu

SEQ ID NO: 30380 - RNA, 21 nt, Artificial Sequence
  Description of Artificial Sequence: Synthetic oligonucleotide
uaaggaugaguggagguaauu

SEQ ID NO: 30381 - RNA, 21 nt, Artificial Sequence
  Description of Artificial Sequence: Synthetic oligonucleotide
uuaaggaugaguggagguauu

SEQ ID NO: 30382 - RNA, 21 nt, Artificial Sequence
  Description of Artificial Sequence: Synthetic oligonucleotide
ucuaaggaugaguggagguuu

SEQ ID NO: 30383 - RNA, 21 nt, Artificial Sequence
  Description of Artificial Sequence: Synthetic oligonucleotide
uucuaaggaugaguggagguu

SEQ ID NO: 30384 - RNA, 21 nt, Artificial Sequence
  Description of Artificial Sequence: Synthetic oligonucleotide
ucucuaaggaugaguggaguu

SEQ ID NO: 30385 - RNA, 21 nt, Artificial Sequence
  Description of Artificial Sequence: Synthetic oligonucleotide
ugcucuaaggaugaguggauu

SEQ ID NO: 30386 - RNA, 21 nt, Artificial Sequence
  Description of Artificial Sequence: Synthetic oligonucleotide
uggcucuaaggaugagugguu

SEQ ID NO: 30387 - RNA, 21 nt, Artificial Sequence
  Description of Artificial Sequence: Synthetic oligonucleotide
ugggcucuaaggaugaguguu

SEQ ID NO: 30388 - RNA, 21 nt, Artificial Sequence
  Description of Artificial Sequence: Synthetic oligonucleotide
uugggcucuaaggaugaguuu

SEQ ID NO: 30389 - RNA, 21 nt, Artificial Sequence
  Description of Artificial Sequence: Synthetic oligonucleotide
ugugggcucuaaggaugaguu

SEQ ID NO: 30390 - RNA, 21 nt, Artificial Sequence
  Description of Artificial Sequence: Synthetic oligonucleotide
uagugggcucuaaggaugauu

SEQ ID NO: 30391 - RNA, 21 nt, Artificial Sequence
  Description of Artificial Sequence: Synthetic oligonucleotide
ucagugggcucuaaggauguu

SEQ ID NO: 30392 - RNA, 21 nt, Artificial Sequence
  Description of Artificial Sequence: Synthetic oligonucleotide
uucagugggcucuaaggauuu

SEQ ID NO: 30393 - RNA, 21 nt, Artificial Sequence
  Description of Artificial Sequence: Synthetic oligonucleotide
ugucagugggcucuaaggauu

SEQ ID NO: 30394 - RNA, 21 nt, Artificial Sequence
  Description of Artificial Sequence: Synthetic oligonucleotide
uagucagugggcucuaagguu

SEQ ID NO: 30395 - RNA, 21 nt, Artificial Sequence
  Description of Artificial Sequence: Synthetic oligonucleotide
ucagucagugggcucuaaguu

SEQ ID NO: 30396 - RNA, 21 nt, Artificial Sequence
  Description of Artificial Sequence: Synthetic oligonucleotide
ugcagucagugggcucuaauu

SEQ ID NO: 30397 - RNA, 21 nt, Artificial Sequence
  Description of Artificial Sequence: Synthetic oligonucleotide
uagcagucagugggcucuauu

SEQ ID NO: 30398 - RNA, 21 nt, Artificial Sequence
  Description of Artificial Sequence: Synthetic oligonucleotide
ugagcagucagugggcucuuu

SEQ ID NO: 30399 - RNA, 21 nt, Artificial Sequence
  Description of Artificial Sequence: Synthetic oligonucleotide
uggagcagucagugggcucuu

SEQ ID NO: 30400 - RNA, 21 nt, Artificial Sequence
  Description of Artificial Sequence: Synthetic oligonucleotide
ugggagcagucagugggcuuu

SEQ ID NO: 30401 - RNA, 21 nt, Artificial Sequence
  Description of Artificial Sequence: Synthetic oligonucleotide
uggggagcagucagugggcuu

SEQ ID NO: 30402 - RNA, 21 nt, Artificial Sequence
  Description of Artificial Sequence: Synthetic oligonucleotide
uaggggagcagucaguggguu

SEQ ID NO: 30403 - RNA, 21 nt, Artificial Sequence
  Description of Artificial Sequence: Synthetic oligonucleotide
uaaggggagcagucagugguu

SEQ ID NO: 30404 - RNA, 21 nt, Artificial Sequence
  Description of Artificial Sequence: Synthetic oligonucleotide
uaaaggggagcagucaguguu

SEQ ID NO: 30405 - RNA, 21 nt, Artificial Sequence
  Description of Artificial Sequence: Synthetic oligonucleotide
uuaaaggggagcagucaguuu

SEQ ID NO: 30406 - RNA, 21 nt, Artificial Sequence
  Description of Artificial Sequence: Synthetic oligonucleotide
uauaaaggggagcagucaguu

SEQ ID NO: 30407 - RNA, 21 nt, Artificial Sequence
  Description of Artificial Sequence: Synthetic oligonucleotide
uuauaaaggggagcagucauu

SEQ ID NO: 30408 - RNA, 21 nt, Artificial Sequence
  Description of Artificial Sequence: Synthetic oligonucleotide
uguauaaaggggagcagucuu

SEQ ID NO: 30409 - RNA, 21 nt, Artificial Sequence
  Description of Artificial Sequence: Synthetic oligonucleotide
ugguauaaaggggagcaguuu

SEQ ID NO: 30410 - RNA, 21 nt, Artificial Sequence
  Description of Artificial Sequence: Synthetic oligonucleotide
uagguauaaaggggagcaguu

SEQ ID NO: 30411 - RNA, 21 nt, Artificial Sequence
  Description of Artificial Sequence: Synthetic oligonucleotide
ucagguauaaaggggagcauu

SEQ ID NO: 30412 - RNA, 21 nt, Artificial Sequence
  Description of Artificial Sequence: Synthetic oligonucleotide
uacagguauaaaggggagcuu

SEQ ID NO: 30413 - RNA, 21 nt, Artificial Sequence
  Description of Artificial Sequence: Synthetic oligonucleotide
uaacagguauaaaggggaguu

SEQ ID NO: 30414 - RNA, 21 nt, Artificial Sequence
  Description of Artificial Sequence: Synthetic oligonucleotide
ucaacagguauaaaggggauu

SEQ ID NO: 30415 - RNA, 21 nt, Artificial Sequence
  Description of Artificial Sequence: Synthetic oligonucleotide
uccaacagguauaaagggguu

SEQ ID NO: 30416 - RNA, 21 nt, Artificial Sequence
  Description of Artificial Sequence: Synthetic oligonucleotide
ugccaacagguauaaaggguu

SEQ ID NO: 30417 - RNA, 21 nt, Artificial Sequence
  Description of Artificial Sequence: Synthetic oligonucleotide
uggccaacagguauaaagguu

SEQ ID NO: 30418 - RNA, 21 nt, Artificial Sequence
  Description of Artificial Sequence: Synthetic oligonucleotide
ugggccaacagguauaaaguu

SEQ ID NO: 30419 - RNA, 21 nt, Artificial Sequence
  Description of Artificial Sequence: Synthetic oligonucleotide
uagggccaacagguauaaauu

SEQ ID NO: 30420 - RNA, 21 nt, Artificial Sequence
  Description of Artificial Sequence: Synthetic oligonucleotide
ucagggccaacagguauaauu

SEQ ID NO: 30421 - RNA, 21 nt, Artificial Sequence
  Description of Artificial Sequence: Synthetic oligonucleotide
ugcagggccaacagguauauu

SEQ ID NO: 30422 - RNA, 21 nt, Artificial Sequence
  Description of Artificial Sequence: Synthetic oligonucleotide
uggcagggccaacagguauuu

SEQ ID NO: 30423 - RNA, 21 nt, Artificial Sequence
  Description of Artificial Sequence: Synthetic oligonucleotide
uaggcagggccaacagguauu

SEQ ID NO: 30424 - RNA, 21 nt, Artificial Sequence
  Description of Artificial Sequence: Synthetic oligonucleotide
uuaggcagggccaacagguuu

SEQ ID NO: 30425 - RNA, 21 nt, Artificial Sequence
  Description of Artificial Sequence: Synthetic oligonucleotide
uauaggcagggccaacagguu

SEQ ID NO: 30426 - RNA, 21 nt, Artificial Sequence
  Description of Artificial Sequence: Synthetic oligonucleotide
uuauaggcagggccaacaguu

SEQ ID NO: 30427 - RNA, 21 nt, Artificial Sequence
  Description of Artificial Sequence: Synthetic oligonucleotide
ucuauaggcagggccaacauu

SEQ ID NO: 30428 - RNA, 21 nt, Artificial Sequence
  Description of Artificial Sequence: Synthetic oligonucleotide
uccuauaggcagggccaacuu

SEQ ID NO: 30429 - RNA, 21 nt, Artificial Sequence
  Description of Artificial Sequence: Synthetic oligonucleotide
uuccuauaggcagggccaauu

SEQ ID NO: 30430 - RNA, 21 nt, Artificial Sequence
  Description of Artificial Sequence: Synthetic oligonucleotide
ucuccuauaggcagggccauu

SEQ ID NO: 30431 - RNA, 21 nt, Artificial Sequence
  Description of Artificial Sequence: Synthetic oligonucleotide
uucuccuauaggcagggccuu

SEQ ID NO: 30432 - RNA, 21 nt, Artificial Sequence
  Description of Artificial Sequence: Synthetic oligonucleotide
ucucuccuauaggcagggcuu

SEQ ID NO: 30433 - RNA, 21 nt, Artificial Sequence
  Description of Artificial Sequence: Synthetic oligonucleotide
uucucuccuauaggcaggguu

SEQ ID NO: 30434 - RNA, 21 nt, Artificial Sequence
  Description of Artificial Sequence: Synthetic oligonucleotide
uuucucuccuauaggcagguu

SEQ ID NO: 30435 - RNA, 21 nt, Artificial Sequence
  Description of Artificial Sequence: Synthetic oligonucleotide
uauucucuccuauaggcaguu

SEQ ID NO: 30436 - RNA, 21 nt, Artificial Sequence
  Description of Artificial Sequence: Synthetic oligonucleotide
uuauucucuccuauaggcauu

SEQ ID NO: 30437 - RNA, 21 nt, Artificial Sequence
  Description of Artificial Sequence: Synthetic oligonucleotide
uauauucucuccuauaggcuu

SEQ ID NO: 30438 - RNA, 21 nt, Artificial Sequence
  Description of Artificial Sequence: Synthetic oligonucleotide
uaauauucucuccuauagguu

SEQ ID NO: 30439 - RNA, 21 nt, Artificial Sequence
  Description of Artificial Sequence: Synthetic oligonucleotide
uaaauauucucuccuauaguu

SEQ ID NO: 30440 - RNA, 21 nt, Artificial Sequence
  Description of Artificial Sequence: Synthetic oligonucleotide
ucaaauauucucuccuauauu

SEQ ID NO: 30441 - RNA, 21 nt, Artificial Sequence
  Description of Artificial Sequence: Synthetic oligonucleotide
uccaaauauucucuccuauuu

SEQ ID NO: 30442 - RNA, 21 nt, Artificial Sequence
  Description of Artificial Sequence: Synthetic oligonucleotide
uuccaaauauucucuccuauu

SEQ ID NO: 30443 - RNA, 21 nt, Artificial Sequence
  Description of Artificial Sequence: Synthetic oligonucleotide
ucuccaaauauucucuccuuu

SEQ ID NO: 30444 - RNA, 21 nt, Artificial Sequence
  Description of Artificial Sequence: Synthetic oligonucleotide
uucuccaaauauucucuccuu

SEQ ID NO: 30445 - RNA, 21 nt, Artificial Sequence
  Description of Artificial Sequence: Synthetic oligonucleotide
uaucuccaaauauucucucuu

SEQ ID NO: 30446 - RNA, 21 nt, Artificial Sequence
  Description of Artificial Sequence: Synthetic oligonucleotide
uuaucuccaaauauucucuuu

SEQ ID NO: 30447 - RNA, 21 nt, Artificial Sequence
  Description of Artificial Sequence: Synthetic oligonucleotide
ucuaucuccaaauauucucuu

SEQ ID NO: 30448 - RNA, 21 nt, Artificial Sequence
  Description of Artificial Sequence: Synthetic oligonucleotide
uccuaucuccaaauauucuuu

SEQ ID NO: 30449 - RNA, 21 nt, Artificial Sequence
  Description of Artificial Sequence: Synthetic oligonucleotide
ugccuaucuccaaauauucuu

SEQ ID NO: 30450 - RNA, 21 nt, Artificial Sequence
  Description of Artificial Sequence: Synthetic oligonucleotide
uugccuaucuccaaauauuuu

SEQ ID NO: 30451 - RNA, 21 nt, Artificial Sequence
  Description of Artificial Sequence: Synthetic oligonucleotide
ucugccuaucuccaaauauuu

SEQ ID NO: 30452 - RNA, 21 nt, Artificial Sequence
  Description of Artificial Sequence: Synthetic oligonucleotide
ugcugccuaucuccaaauauu

SEQ ID NO: 30453 - RNA, 21 nt, Artificial Sequence
  Description of Artificial Sequence: Synthetic oligonucleotide
uagcugccuaucuccaaauuu

SEQ ID NO: 30454 - RNA, 21 nt, Artificial Sequence
  Description of Artificial Sequence: Synthetic oligonucleotide
uaagcugccuaucuccaaauu

SEQ ID NO: 30455 - RNA, 21 nt, Artificial Sequence
  Description of Artificial Sequence: Synthetic oligonucleotide
ugaagcugccuaucuccaauu

SEQ ID NO: 30456 - RNA, 21 nt, Artificial Sequence
  Description of Artificial Sequence: Synthetic oligonucleotide
uugaagcugccuaucuccauu

SEQ ID NO: 30457 - RNA, 21 nt, Artificial Sequence
  Description of Artificial Sequence: Synthetic oligonucleotide
ucugaagcugccuaucuccuu

SEQ ID NO: 30458 - RNA, 21 nt, Artificial Sequence
  Description of Artificial Sequence: Synthetic oligonucleotide
uccugaagcugccuaucucuu

SEQ ID NO: 30459 - RNA, 21 nt, Artificial Sequence
  Description of Artificial Sequence: Synthetic oligonucleotide
uuccugaagcugccuaucuuu

SEQ ID NO: 30460 - RNA, 21 nt, Artificial Sequence
  Description of Artificial Sequence: Synthetic oligonucleotide
uauccugaagcugccuaucuu

SEQ ID NO: 30461 - RNA, 21 nt, Artificial Sequence
  Description of Artificial Sequence: Synthetic oligonucleotide
ucauccugaagcugccuauuu

SEQ ID NO: 30462 - RNA, 21 nt, Artificial Sequence
  Description of Artificial Sequence: Synthetic oligonucleotide
ugcauccugaagcugccuauu

SEQ ID NO: 30463 - RNA, 21 nt, Artificial Sequence
  Description of Artificial Sequence: Synthetic oligonucleotide
uugcauccugaagcugccuuu

SEQ ID NO: 30464 - RNA, 21 nt, Artificial Sequence
  Description of Artificial Sequence: Synthetic oligonucleotide
uaugcauccugaagcugccuu

SEQ ID NO: 30465 - RNA, 21 nt, Artificial Sequence
  Description of Artificial Sequence: Synthetic oligonucleotide
uaaugcauccugaagcugcuu

SEQ ID NO: 30466 - RNA, 21 nt, Artificial Sequence
  Description of Artificial Sequence: Synthetic oligonucleotide
ucaaugcauccugaagcuguu

SEQ ID NO: 30467 - RNA, 21 nt, Artificial Sequence
  Description of Artificial Sequence: Synthetic oligonucleotide
ugcaaugcauccugaagcuuu

SEQ ID NO: 30468 - RNA, 21 nt, Artificial Sequence
  Description of Artificial Sequence: Synthetic oligonucleotide
uugcaaugcauccugaagcuu

SEQ ID NO: 30469 - RNA, 21 nt, Artificial Sequence
  Description of Artificial Sequence: Synthetic oligonucleotide
uuugcaaugcauccugaaguu

SEQ ID NO: 30470 - RNA, 21 nt, Artificial Sequence
  Description of Artificial Sequence: Synthetic oligonucleotide
uauugcaaugcauccugaauu

SEQ ID NO: 30471 - RNA, 21 nt, Artificial Sequence
  Description of Artificial Sequence: Synthetic oligonucleotide
ugauugcaaugcauccugauu

SEQ ID NO: 30472 - RNA, 21 nt, Artificial Sequence
  Description of Artificial Sequence: Synthetic oligonucleotide
uugauugcaaugcauccuguu

SEQ ID NO: 30473 - RNA, 21 nt, Artificial Sequence
  Description of Artificial Sequence: Synthetic oligonucleotide
uaugauugcaaugcauccuuu

SEQ ID NO: 30474 - RNA, 21 nt, Artificial Sequence
  Description of Artificial Sequence: Synthetic oligonucleotide
ugaugauugcaaugcauccuu

SEQ ID NO: 30475 - RNA, 21 nt, Artificial Sequence
  Description of Artificial Sequence: Synthetic oligonucleotide
uggaugauugcaaugcaucuu

SEQ ID NO: 30476 - RNA, 21 nt, Artificial Sequence
  Description of Artificial Sequence: Synthetic oligonucleotide
uaggaugauugcaaugcauuu

SEQ ID NO: 30477 - RNA, 21 nt, Artificial Sequence
  Description of Artificial Sequence: Synthetic oligonucleotide
uaaggaugauugcaaugcauu

SEQ ID NO: 30478 - RNA, 21 nt, Artificial Sequence
  Description of Artificial Sequence: Synthetic oligonucleotide
uaaaggaugauugcaaugcuu

SEQ ID NO: 30479 - RNA, 21 nt, Artificial Sequence
  Description of Artificial Sequence: Synthetic oligonucleotide
uaaaaggaugauugcaauguu

SEQ ID NO: 30480 - RNA, 21 nt, Artificial Sequence
  Description of Artificial Sequence: Synthetic oligonucleotide
ugaaaaggaugauugcaauuu

SEQ ID NO: 30481 - RNA, 21 nt, Artificial Sequence
  Description of Artificial Sequence: Synthetic oligonucleotide
uagaaaaggaugauugcaauu

SEQ ID NO: 30482 - RNA, 21 nt, Artificial Sequence
  Description of Artificial Sequence: Synthetic oligonucleotide
uaagaaaaggaugauugcauu

SEQ ID NO: 30483 - RNA, 21 nt, Artificial Sequence
  Description of Artificial Sequence: Synthetic oligonucleotide
uuaagaaaaggaugauugcuu

SEQ ID NO: 30484 - RNA, 21 nt, Artificial Sequence
  Description of Artificial Sequence: Synthetic oligonucleotide
uuuaagaaaaggaugauuguu

SEQ ID NO: 30485 - RNA, 21 nt, Artificial Sequence
  Description of Artificial Sequence: Synthetic oligonucleotide
uuuuaagaaaaggaugauuuu

SEQ ID NO: 30486 - RNA, 21 nt, Artificial Sequence
  Description of Artificial Sequence: Synthetic oligonucleotide
uauuuaagaaaaggaugauuu

SEQ ID NO: 30487 - RNA, 21 nt, Artificial Sequence
  Description of Artificial Sequence: Synthetic oligonucleotide
uaauuuaagaaaaggaugauu

SEQ ID NO: 30488 - RNA, 21 nt, Artificial Sequence
  Description of Artificial Sequence: Synthetic oligonucleotide
uuaauuuaagaaaaggauguu

SEQ ID NO: 30489 - RNA, 21 nt, Artificial Sequence
  Description of Artificial Sequence: Synthetic oligonucleotide
uauaauuuaagaaaaggauuu

SEQ ID NO: 30490 - RNA, 21 nt, Artificial Sequence
  Description of Artificial Sequence: Synthetic oligonucleotide
ucauaauuuaagaaaaggauu

SEQ ID NO: 30491 - RNA, 21 nt, Artificial Sequence
  Description of Artificial Sequence: Synthetic oligonucleotide
uacauaauuuaagaaaagguu

SEQ ID NO: 30492 - RNA, 21 nt, Artificial Sequence
  Description of Artificial Sequence: Synthetic oligonucleotide
ugacauaauuuaagaaaaguu

SEQ ID NO: 30493 - RNA, 21 nt, Artificial Sequence
  Description of Artificial Sequence: Synthetic oligonucleotide
uugacauaauuuaagaaaauu

SEQ ID NO: 30494 - RNA, 21 nt, Artificial Sequence
  Description of Artificial Sequence: Synthetic oligonucleotide
ugugacauaauuuaagaaauu

SEQ ID NO: 30495 - RNA, 21 nt, Artificial Sequence
  Description of Artificial Sequence: Synthetic oligonucleotide
uagugacauaauuuaagaauu

SEQ ID NO: 30496 - RNA, 21 nt, Artificial Sequence
  Description of Artificial Sequence: Synthetic oligonucleotide
uuagugacauaauuuaagauu

SEQ ID NO: 30497 - RNA, 21 nt, Artificial Sequence
  Description of Artificial Sequence: Synthetic oligonucleotide
ucuagugacauaauuuaaguu

SEQ ID NO: 30498 - RNA, 21 nt, Artificial Sequence
  Description of Artificial Sequence: Synthetic oligonucleotide
uacuagugacauaauuuaauu

SEQ ID NO: 30499 - RNA, 21 nt, Artificial Sequence
  Description of Artificial Sequence: Synthetic oligonucleotide
ugacuagugacauaauuuauu

SEQ ID NO: 30500 - RNA, 21 nt, Artificial Sequence
  Description of Artificial Sequence: Synthetic oligonucleotide
uagacuagugacauaauuuuu

SEQ ID NO: 30501 - RNA, 21 nt, Artificial Sequence
  Description of Artificial Sequence: Synthetic oligonucleotide
uaagacuagugacauaauuuu

SEQ ID NO: 30502 - RNA, 21 nt, Artificial Sequence
  Description of Artificial Sequence: Synthetic oligonucleotide
uaaagacuagugacauaauuu

SEQ ID NO: 30503 - RNA, 21 nt, Artificial Sequence
  Description of Artificial Sequence: Synthetic oligonucleotide
uaaaagacuagugacauaauu

SEQ ID NO: 30504 - RNA, 21 nt, Artificial Sequence
  Description of Artificial Sequence: Synthetic oligonucleotide
uuaaaagacuagugacauauu

SEQ ID NO: 30505 - RNA, 21 nt, Artificial Sequence
  Description of Artificial Sequence: Synthetic oligonucleotide
uauaaaagacuagugacauuu

SEQ ID NO: 30506 - RNA, 21 nt, Artificial Sequence
  Description of Artificial Sequence: Synthetic oligonucleotide
uaauaaaagacuagugacauu

SEQ ID NO: 30507 - RNA, 21 nt, Artificial Sequence
  Description of Artificial Sequence: Synthetic oligonucleotide
uaaauaaaagacuagugacuu

SEQ ID NO: 30508 - RNA, 21 nt, Artificial Sequence
  Description of Artificial Sequence: Synthetic oligonucleotide
uaaaauaaaagacuagugauu

SEQ ID NO: 30509 - RNA, 21 nt, Artificial Sequence
  Description of Artificial Sequence: Synthetic oligonucleotide
uaaaaauaaaagacuaguguu

SEQ ID NO: 30510 - RNA, 21 nt, Artificial Sequence
  Description of Artificial Sequence: Synthetic oligonucleotide
uaaaaaauaaaagacuaguuu

SEQ ID NO: 30511 - RNA, 21 nt, Artificial Sequence
  Description of Artificial Sequence: Synthetic oligonucleotide
ugaaaaaauaaaagacuaguu

SEQ ID NO: 30512 - RNA, 21 nt, Artificial Sequence
  Description of Artificial Sequence: Synthetic oligonucleotide
uggaaaaaauaaaagacuauu

SEQ ID NO: 30513 - RNA, 21 nt, Artificial Sequence
  Description of Artificial Sequence: Synthetic oligonucleotide
ugggaaaaaauaaaagacuuu

SEQ ID NO: 30514 - RNA, 21 nt, Artificial Sequence
  Description of Artificial Sequence: Synthetic oligonucleotide
uggggaaaaaauaaaagacuu

SEQ ID NO: 30515 - RNA, 21 nt, Artificial Sequence
  Description of Artificial Sequence: Synthetic oligonucleotide
uaggggaaaaaauaaaagauu

SEQ ID NO: 30516 - RNA, 21 nt, Artificial Sequence
  Description of Artificial Sequence: Synthetic oligonucleotide
ugaggggaaaaaauaaaaguu

SEQ ID NO: 30517 - RNA, 21 nt, Artificial Sequence
  Description of Artificial Sequence: Synthetic oligonucleotide
uagaggggaaaaaauaaaauu

SEQ ID NO: 30518 - RNA, 21 nt, Artificial Sequence
  Description of Artificial Sequence: Synthetic oligonucleotide
uaagaggggaaaaaauaaauu

SEQ ID NO: 30519 - RNA, 21 nt, Artificial Sequence
  Description of Artificial Sequence: Synthetic oligonucleotide
ucaagaggggaaaaaauaauu

SEQ ID NO: 30520 - RNA, 21 nt, Artificial Sequence
  Description of Artificial Sequence: Synthetic oligonucleotide
uucaagaggggaaaaaauauu

SEQ ID NO: 30521 - RNA, 21 nt, Artificial Sequence
  Description of Artificial Sequence: Synthetic oligonucleotide
uuucaagaggggaaaaaauuu

SEQ ID NO: 30522 - RNA, 21 nt, Artificial Sequence
  Description of Artificial Sequence: Synthetic oligonucleotide
uguucaagaggggaaaaaauu

SEQ ID NO: 30523 - RNA, 21 nt, Artificial Sequence
  Description of Artificial Sequence: Synthetic oligonucleotide
uaguucaagaggggaaaaauu

SEQ ID NO: 30524 - RNA, 21 nt, Artificial Sequence
  Description of Artificial Sequence: Synthetic oligonucleotide
uaaguucaagaggggaaaauu

SEQ ID NO: 30525 - RNA, 21 nt, Artificial Sequence
  Description of Artificial Sequence: Synthetic oligonucleotide
uaaaguucaagaggggaaauu

SEQ ID NO: 30526 - RNA, 21 nt, Artificial Sequence
  Description of Artificial Sequence: Synthetic oligonucleotide
ugaaaguucaagaggggaauu

SEQ ID NO: 30527 - RNA, 21 nt, Artificial Sequence
  Description of Artificial Sequence: Synthetic oligonucleotide
uggaaaguucaagaggggauu

SEQ ID NO: 30528 - RNA, 21 nt, Artificial Sequence
  Description of Artificial Sequence: Synthetic oligonucleotide
uaggaaaguucaagagggguu

SEQ ID NO: 30529 - RNA, 21 nt, Artificial Sequence
  Description of Artificial Sequence: Synthetic oligonucleotide
ugaggaaaguucaagaggguu

SEQ ID NO: 30530 - RNA, 21 nt, Artificial Sequence
  Description of Artificial Sequence: Synthetic oligonucleotide
uugaggaaaguucaagagguu

SEQ ID NO: 30531 - RNA, 21 nt, Artificial Sequence
  Description of Artificial Sequence: Synthetic oligonucleotide
ugugaggaaaguucaagaguu

SEQ ID NO: 30532 - RNA, 21 nt, Artificial Sequence
  Description of Artificial Sequence: Synthetic oligonucleotide
uugugaggaaaguucaagauu

SEQ ID NO: 30533 - RNA, 21 nt, Artificial Sequence
  Description of Artificial Sequence: Synthetic oligonucleotide
ugugugaggaaaguucaaguu

SEQ ID NO: 30534 - RNA, 21 nt, Artificial Sequence
  Description of Artificial Sequence: Synthetic oligonucleotide
uggugugaggaaaguucaauu

SEQ ID NO: 30535 - RNA, 21 nt, Artificial Sequence
  Description of Artificial Sequence: Synthetic oligonucleotide
uaggugugaggaaaguucauu

SEQ ID NO: 30536 - RNA, 21 nt, Artificial Sequence
  Description of Artificial Sequence: Synthetic oligonucleotide
ucaggugugaggaaaguucuu

SEQ ID NO: 30537 - RNA, 21 nt, Artificial Sequence
  Description of Artificial Sequence: Synthetic oligonucleotide
uccaggugugaggaaaguuuu

SEQ ID NO: 30538 - RNA, 21 nt, Artificial Sequence
  Description of Artificial Sequence: Synthetic oligonucleotide
uuccaggugugaggaaaguuu

SEQ ID NO: 30539 - RNA, 21 nt, Artificial Sequence
  Description of Artificial Sequence: Synthetic oligonucleotide
uuuccaggugugaggaaaguu

SEQ ID NO: 30540 - RNA, 21 nt, Artificial Sequence
  Description of Artificial Sequence: Synthetic oligonucleotide
ucuuccaggugugaggaaauu

SEQ ID NO: 30541 - RNA, 21 nt, Artificial Sequence
  Description of Artificial Sequence: Synthetic oligonucleotide
uucuuccaggugugaggaauu

SEQ ID NO: 30542 - RNA, 21 nt, Artificial Sequence
  Description of Artificial Sequence: Synthetic oligonucleotide
uuucuuccaggugugaggauu

SEQ ID NO: 30543 - RNA, 21 nt, Artificial Sequence
  Description of Artificial Sequence: Synthetic oligonucleotide
uuuucuuccaggugugagguu

SEQ ID NO: 30544 - RNA, 21 nt, Artificial Sequence
  Description of Artificial Sequence: Synthetic oligonucleotide
uguuucuuccaggugugaguu

SEQ ID NO: 30545 - RNA, 21 nt, Artificial Sequence
  Description of Artificial Sequence: Synthetic oligonucleotide
uuguuucuuccaggugugauu

SEQ ID NO: 30546 - RNA, 21 nt, Artificial Sequence
  Description of Artificial Sequence: Synthetic oligonucleotide
uuuguuucuuccagguguguu

SEQ ID NO: 30547 - RNA, 21 nt, Artificial Sequence
  Description of Artificial Sequence: Synthetic oligonucleotide
uuuuguuucuuccagguguuu

SEQ ID NO: 30548 - RNA, 21 nt, Artificial Sequence
  Description of Artificial Sequence: Synthetic oligonucleotide
ucuuuguuucuuccagguguu

SEQ ID NO: 30549 - RNA, 21 nt, Artificial Sequence
  Description of Artificial Sequence: Synthetic oligonucleotide
uacuuuguuucuuccagguuu

SEQ ID NO: 30550 - RNA, 21 nt, Artificial Sequence
  Description of Artificial Sequence: Synthetic oligonucleotide
uuacuuuguuucuuccagguu

SEQ ID NO: 30551 - RNA, 21 nt, Artificial Sequence
  Description of Artificial Sequence: Synthetic oligonucleotide
ucuacuuuguuucuuccaguu

SEQ ID NO: 30552 - RNA, 21 nt, Artificial Sequence
  Description of Artificial Sequence: Synthetic oligonucleotide
uccuacuuuguuucuuccauu

SEQ ID NO: 30553 - RNA, 21 nt, Artificial Sequence
  Description of Artificial Sequence: Synthetic oligonucleotide
uuccuacuuuguuucuuccuu

SEQ ID NO: 30554 - RNA, 21 nt, Artificial Sequence
  Description of Artificial Sequence: Synthetic oligonucleotide
uuuccuacuuuguuucuucuu

SEQ ID NO: 30555 - RNA, 21 nt, Artificial Sequence
  Description of Artificial Sequence: Synthetic oligonucleotide
uuuuccuacuuuguuucuuuu

SEQ ID NO: 30556 - RNA, 21 nt, Artificial Sequence
  Description of Artificial Sequence: Synthetic oligonucleotide
uuuuuccuacuuuguuucuuu

SEQ ID NO: 30557 - RNA, 21 nt, Artificial Sequence
  Description of Artificial Sequence: Synthetic oligonucleotide
uuuuuuccuacuuuguuucuu

SEQ ID NO: 30558 - RNA, 21 nt, Artificial Sequence
  Description of Artificial Sequence: Synthetic oligonucleotide
ucuuuuuccuacuuuguuuuu

SEQ ID NO: 30559 - RNA, 21 nt, Artificial Sequence
  Description of Artificial Sequence: Synthetic oligonucleotide
uacuuuuuccuacuuuguuuu

SEQ ID NO: 30560 - RNA, 21 nt, Artificial Sequence
  Description of Artificial Sequence: Synthetic oligonucleotide
ucacuuuuuccuacuuuguuu

SEQ ID NO: 30561 - RNA, 21 nt, Artificial Sequence
  Description of Artificial Sequence: Synthetic oligonucleotide
uucacuuuuuccuacuuuguu

SEQ ID NO: 30562 - RNA, 21 nt, Artificial Sequence
  Description of Artificial Sequence: Synthetic oligonucleotide
uuucacuuuuuccuacuuuuu

SEQ ID NO: 30563 - RNA, 21 nt, Artificial Sequence
  Description of Artificial Sequence: Synthetic oligonucleotide
uguucacuuuuuccuacuuuu

SEQ ID NO: 30564 - RNA, 21 nt, Artificial Sequence
  Description of Artificial Sequence: Synthetic oligonucleotide
uuguucacuuuuuccuacuuu

SEQ ID NO: 30565 - RNA, 21 nt, Artificial Sequence
  Description of Artificial Sequence: Synthetic oligonucleotide
ucuguucacuuuuuccuacuu

SEQ ID NO: 30566 - RNA, 21 nt, Artificial Sequence
  Description of Artificial Sequence: Synthetic oligonucleotide
uccuguucacuuuuuccuauu

SEQ ID NO: 30567 - RNA, 21 nt, Artificial Sequence
  Description of Artificial Sequence: Synthetic oligonucleotide
ucccuguucacuuuuuccuuu

SEQ ID NO: 30568 - RNA, 21 nt, Artificial Sequence
  Description of Artificial Sequence: Synthetic oligonucleotide
uccccuguucacuuuuuccuu

SEQ ID NO: 30569 - RNA, 21 nt, Artificial Sequence
  Description of Artificial Sequence: Synthetic oligonucleotide
uuccccuguucacuuuuucuu

SEQ ID NO: 30570 - RNA, 21 nt, Artificial Sequence
  Description of Artificial Sequence: Synthetic oligonucleotide
uauccccuguucacuuuuuuu

SEQ ID NO: 30571 - RNA, 21 nt, Artificial Sequence
  Description of Artificial Sequence: Synthetic oligonucleotide
ucauccccuguucacuuuuuu

SEQ ID NO: 30572 - RNA, 21 nt, Artificial Sequence
  Description of Artificial Sequence: Synthetic oligonucleotide
uacauccccuguucacuuuuu

SEQ ID NO: 30573 - RNA, 21 nt, Artificial Sequence
  Description of Artificial Sequence: Synthetic oligonucleotide
ugacauccccuguucacuuuu

SEQ ID NO: 30574 - RNA, 21 nt, Artificial Sequence
  Description of Artificial Sequence: Synthetic oligonucleotide
uugacauccccuguucacuuu

SEQ ID NO: 30575 - RNA, 21 nt, Artificial Sequence
  Description of Artificial Sequence: Synthetic oligonucleotide
uuugacauccccuguucacuu

SEQ ID NO: 30576 - RNA, 21 nt, Artificial Sequence
  Description of Artificial Sequence: Synthetic oligonucleotide
uuuugacauccccuguucauu

SEQ ID NO: 30577 - RNA, 21 nt, Artificial Sequence
  Description of Artificial Sequence: Synthetic oligonucleotide
uauuugacauccccuguucuu

SEQ ID NO: 30578 - RNA, 21 nt, Artificial Sequence
  Description of Artificial Sequence: Synthetic oligonucleotide
ugauuugacauccccuguuuu

SEQ ID NO: 30579 - RNA, 21 nt, Artificial Sequence
  Description of Artificial Sequence: Synthetic oligonucleotide
ucgauuugacauccccuguuu

SEQ ID NO: 30580 - RNA, 21 nt, Artificial Sequence
  Description of Artificial Sequence: Synthetic oligonucleotide
uucgauuugacauccccuguu

SEQ ID NO: 30581 - RNA, 21 nt, Artificial Sequence
  Description of Artificial Sequence: Synthetic oligonucleotide
uaucgauuugacauccccuuu

SEQ ID NO: 30582 - RNA, 21 nt, Artificial Sequence
  Description of Artificial Sequence: Synthetic oligonucleotide
uaaucgauuugacauccccuu

SEQ ID NO: 30583 - RNA, 21 nt, Artificial Sequence
  Description of Artificial Sequence: Synthetic oligonucleotide
ugaaucgauuugacaucccuu

SEQ ID NO: 30584 - RNA, 21 nt, Artificial Sequence
  Description of Artificial Sequence: Synthetic oligonucleotide
uagaaucgauuugacauccuu

SEQ ID NO: 30585 - RNA, 21 nt, Artificial Sequence
  Description of Artificial Sequence: Synthetic oligonucleotide
uaagaaucgauuugacaucuu

SEQ ID NO: 30586 - RNA, 21 nt, Artificial Sequence
  Description of Artificial Sequence: Synthetic oligonucleotide
ucaagaaucgauuugacauuu

SEQ ID NO: 30587 - RNA, 21 nt, Artificial Sequence
  Description of Artificial Sequence: Synthetic oligonucleotide
uucaagaaucgauuugacauu

SEQ ID NO: 30588 - RNA, 21 nt, Artificial Sequence
  Description of Artificial Sequence: Synthetic oligonucleotide
uuucaagaaucgauuugacuu

SEQ ID NO: 30589 - RNA, 21 nt, Artificial Sequence
  Description of Artificial Sequence: Synthetic oligonucleotide
uauucaagaaucgauuugauu

SEQ ID NO: 30590 - RNA, 21 nt, Artificial Sequence
  Description of Artificial Sequence: Synthetic oligonucleotide
uaauucaagaaucgauuuguu

SEQ ID NO: 30591 - RNA, 21 nt, Artificial Sequence
  Description of Artificial Sequence: Synthetic oligonucleotide
ugaauucaagaaucgauuuuu

SEQ ID NO: 30592 - RNA, 21 nt, Artificial Sequence
  Description of Artificial Sequence: Synthetic oligonucleotide
uggaauucaagaaucgauuuu

SEQ ID NO: 30593 - RNA, 21 nt, Artificial Sequence
  Description of Artificial Sequence: Synthetic oligonucleotide
ugggaauucaagaaucgauuu

SEQ ID NO: 30594 - RNA, 21 nt, Artificial Sequence
  Description of Artificial Sequence: Synthetic oligonucleotide
ucgggaauucaagaaucgauu

SEQ ID NO: 30595 - RNA, 21 nt, Artificial Sequence
  Description of Artificial Sequence: Synthetic oligonucleotide
ugcgggaauucaagaaucguu

SEQ ID NO: 30596 - RNA, 21 nt, Artificial Sequence
  Description of Artificial Sequence: Synthetic oligonucleotide
uagcgggaauucaagaaucuu

SEQ ID NO: 30597 - RNA, 21 nt, Artificial Sequence
  Description of Artificial Sequence: Synthetic oligonucleotide
ucagcgggaauucaagaauuu

SEQ ID NO: 30598 - RNA, 21 nt, Artificial Sequence
  Description of Artificial Sequence: Synthetic oligonucleotide
ugcagcgggaauucaagaauu

SEQ ID NO: 30599 - RNA, 21 nt, Artificial Sequence
  Description of Artificial Sequence: Synthetic oligonucleotide
uugcagcgggaauucaagauu

SEQ ID NO: 30600 - RNA, 21 nt, Artificial Sequence
  Description of Artificial Sequence: Synthetic oligonucleotide
uuugcagcgggaauucaaguu

SEQ ID NO: 30601 - RNA, 21 nt, Artificial Sequence
  Description of Artificial Sequence: Synthetic oligonucleotide
ucuugcagcgggaauucaauu

SEQ ID NO: 30602 - RNA, 21 nt, Artificial Sequence
  Description of Artificial Sequence: Synthetic oligonucleotide
ugcuugcagcgggaauucauu

SEQ ID NO: 30603 - RNA, 21 nt, Artificial Sequence
  Description of Artificial Sequence: Synthetic oligonucleotide
uagcuugcagcgggaauucuu

SEQ ID NO: 30604 - RNA, 21 nt, Artificial Sequence
  Description of Artificial Sequence: Synthetic oligonucleotide
uuagcuugcagcgggaauuuu

SEQ ID NO: 30605 - RNA, 21 nt, Artificial Sequence
  Description of Artificial Sequence: Synthetic oligonucleotide
ucuagcuugcagcgggaauuu

SEQ ID NO: 30606 - RNA, 21 nt, Artificial Sequence
  Description of Artificial Sequence: Synthetic oligonucleotide
uucuagcuugcagcgggaauu

SEQ ID NO: 30607 - RNA, 21 nt, Artificial Sequence
  Description of Artificial Sequence: Synthetic oligonucleotide
ucucuagcuugcagcgggauu

SEQ ID NO: 30608 - RNA, 21 nt, Artificial Sequence
  Description of Artificial Sequence: Synthetic oligonucleotide
ugcucuagcuugcagcggguu

SEQ ID NO: 30609 - RNA, 21 nt, Artificial Sequence
  Description of Artificial Sequence: Synthetic oligonucleotide
uggcucuagcuugcagcgguu

SEQ ID NO: 30610 - RNA, 21 nt, Artificial Sequence
  Description of Artificial Sequence: Synthetic oligonucleotide
ucggcucuagcuugcagcguu

SEQ ID NO: 30611 - RNA, 21 nt, Artificial Sequence
  Description of Artificial Sequence: Synthetic oligonucleotide
ugcggcucuagcuugcagcuu

SEQ ID NO: 30612 - RNA, 21 nt, Artificial Sequence
  Description of Artificial Sequence: Synthetic oligonucleotide
uugcggcucuagcuugcaguu

SEQ ID NO: 30613 - RNA, 21 nt, Artificial Sequence
  Description of Artificial Sequence: Synthetic oligonucleotide
ucugcggcucuagcuugcauu

SEQ ID NO: 30614 - RNA, 21 nt, Artificial Sequence
  Description of Artificial Sequence: Synthetic oligonucleotide
uccugcggcucuagcuugcuu

SEQ ID NO: 30615 - RNA, 21 nt, Artificial Sequence
  Description of Artificial Sequence: Synthetic oligonucleotide
ugccugcggcucuagcuuguu

SEQ ID NO: 30616 - RNA, 21 nt, Artificial Sequence
  Description of Artificial Sequence: Synthetic oligonucleotide
uugccugcggcucuagcuuuu

SEQ ID NO: 30617 - RNA, 21 nt, Artificial Sequence
  Description of Artificial Sequence: Synthetic oligonucleotide
ugugccugcggcucuagcuuu

SEQ ID NO: 30618 - RNA, 21 nt, Artificial Sequence
  Description of Artificial Sequence: Synthetic oligonucleotide
uggugccugcggcucuagcuu

SEQ ID NO: 30619 - RNA, 21 nt, Artificial Sequence
  Description of Artificial Sequence: Synthetic oligonucleotide
ugggugccugcggcucuaguu

SEQ ID NO: 30620 - RNA, 21 nt, Artificial Sequence
  Description of Artificial Sequence: Synthetic oligonucleotide
uagggugccugcggcucuauu

SEQ ID NO: 30621 - RNA, 21 nt, Artificial Sequence
  Description of Artificial Sequence: Synthetic oligonucleotide
ugagggugccugcggcucuuu

SEQ ID NO: 30622 - RNA, 21 nt, Artificial Sequence
  Description of Artificial Sequence: Synthetic oligonucleotide
uagagggugccugcggcucuu

SEQ ID NO: 30623 - RNA, 21 nt, Artificial Sequence
  Description of Artificial Sequence: Synthetic oligonucleotide
ugagagggugccugcggcuuu

SEQ ID NO: 30624 - RNA, 21 nt, Artificial Sequence
  Description of Artificial Sequence: Synthetic oligonucleotide
uugagagggugccugcggcuu

SEQ ID NO: 30625 - RNA, 21 nt, Artificial Sequence
  Description of Artificial Sequence: Synthetic oligonucleotide
ugugagagggugccugcgguu

SEQ ID NO: 30626 - RNA, 21 nt, Artificial Sequence
  Description of Artificial Sequence: Synthetic oligonucleotide
uagugagagggugccugcguu

SEQ ID NO: 30627 - RNA, 21 nt, Artificial Sequence
  Description of Artificial Sequence: Synthetic oligonucleotide
ugagugagagggugccugcuu

SEQ ID NO: 30628 - RNA, 21 nt, Artificial Sequence
  Description of Artificial Sequence: Synthetic oligonucleotide
uugagugagagggugccuguu

SEQ ID NO: 30629 - RNA, 21 nt, Artificial Sequence
  Description of Artificial Sequence: Synthetic oligonucleotide
uuugagugagagggugccuuu

SEQ ID NO: 30630 - RNA, 21 nt, Artificial Sequence
  Description of Artificial Sequence: Synthetic oligonucleotide
uauugagugagagggugccuu

SEQ ID NO: 30631 - RNA, 21 nt, Artificial Sequence
  Description of Artificial Sequence: Synthetic oligonucleotide
uaauugagugagagggugcuu

SEQ ID NO: 30632 - RNA, 21 nt, Artificial Sequence
  Description of Artificial Sequence: Synthetic oligonucleotide
uaaauugagugagaggguguu

SEQ ID NO: 30633 - RNA, 21 nt, Artificial Sequence
  Description of Artificial Sequence: Synthetic oligonucleotide
ugaaauugagugagaggguuu

SEQ ID NO: 30634 - RNA, 21 nt, Artificial Sequence
  Description of Artificial Sequence: Synthetic oligonucleotide
uggaaauugagugagaggguu

SEQ ID NO: 30635 - RNA, 21 nt, Artificial Sequence
  Description of Artificial Sequence: Synthetic oligonucleotide
uuggaaauugagugagagguu

SEQ ID NO: 30636 - RNA, 21 nt, Artificial Sequence
  Description of Artificial Sequence: Synthetic oligonucleotide
uguggaaauugagugagaguu

SEQ ID NO: 30637 - RNA, 21 nt, Artificial Sequence
  Description of Artificial Sequence: Synthetic oligonucleotide
uaguggaaauugagugagauu

SEQ ID NO: 30638 - RNA, 21 nt, Artificial Sequence
  Description of Artificial Sequence: Synthetic oligonucleotide
ugaguggaaauugagugaguu

SEQ ID NO: 30639 - RNA, 21 nt, Artificial Sequence
  Description of Artificial Sequence: Synthetic oligonucleotide
uugaguggaaauugagugauu

SEQ ID NO: 30640 - RNA, 21 nt, Artificial Sequence
  Description of Artificial Sequence: Synthetic oligonucleotide
ucugaguggaaauugaguguu

SEQ ID NO: 30641 - RNA, 21 nt, Artificial Sequence
  Description of Artificial Sequence: Synthetic oligonucleotide
uucugaguggaaauugaguuu

SEQ ID NO: 30642 - RNA, 21 nt, Artificial Sequence
  Description of Artificial Sequence: Synthetic oligonucleotide
uuucugaguggaaauugaguu

SEQ ID NO: 30643 - RNA, 21 nt, Artificial Sequence
  Description of Artificial Sequence: Synthetic oligonucleotide
uguucugaguggaaauugauu

SEQ ID NO: 30644 - RNA, 21 nt, Artificial Sequence
  Description of Artificial Sequence: Synthetic oligonucleotide
ugguucugaguggaaauuguu

SEQ ID NO: 30645 - RNA, 21 nt, Artificial Sequence
  Description of Artificial Sequence: Synthetic oligonucleotide
uggguucugaguggaaauuuu

SEQ ID NO: 30646 - RNA, 21 nt, Artificial Sequence
  Description of Artificial Sequence: Synthetic oligonucleotide
uaggguucugaguggaaauuu

SEQ ID NO: 30647 - RNA, 21 nt, Artificial Sequence
  Description of Artificial Sequence: Synthetic oligonucleotide
uuaggguucugaguggaaauu

SEQ ID NO: 30648 - RNA, 21 nt, Artificial Sequence
  Description of Artificial Sequence: Synthetic oligonucleotide
uauaggguucugaguggaauu

SEQ ID NO: 30649 - RNA, 21 nt, Artificial Sequence
  Description of Artificial Sequence: Synthetic oligonucleotide
uuauaggguucugaguggauu

SEQ ID NO: 30650 - RNA, 21 nt, Artificial Sequence
  Description of Artificial Sequence: Synthetic oligonucleotide
uuuauaggguucugagugguu

SEQ ID NO: 30651 - RNA, 21 nt, Artificial Sequence
  Description of Artificial Sequence: Synthetic oligonucleotide
uuuuauaggguucugaguguu

SEQ ID NO: 30652 - RNA, 21 nt, Artificial Sequence
  Description of Artificial Sequence: Synthetic oligonucleotide
uguuuauaggguucugaguuu

SEQ ID NO: 30653 - RNA, 21 nt, Artificial Sequence
  Description of Artificial Sequence: Synthetic oligonucleotide
uuguuuauaggguucugaguu

SEQ ID NO: 30654 - RNA, 21 nt, Artificial Sequence
  Description of Artificial Sequence: Synthetic oligonucleotide
uguguuuauaggguucugauu

SEQ ID NO: 30655 - RNA, 21 nt, Artificial Sequence
  Description of Artificial Sequence: Synthetic oligonucleotide
ugguguuuauaggguucuguu

SEQ ID NO: 30656 - RNA, 21 nt, Artificial Sequence
  Description of Artificial Sequence: Synthetic oligonucleotide
uugguguuuauaggguucuuu

SEQ ID NO: 30657 - RNA, 21 nt, Artificial Sequence
  Description of Artificial Sequence: Synthetic oligonucleotide
ucugguguuuauaggguucuu

SEQ ID NO: 30658 - RNA, 21 nt, Artificial Sequence
  Description of Artificial Sequence: Synthetic oligonucleotide
uacugguguuuauaggguuuu

SEQ ID NO: 30659 - RNA, 21 nt, Artificial Sequence
  Description of Artificial Sequence: Synthetic oligonucleotide
ucacugguguuuauaggguuu

SEQ ID NO: 30660 - RNA, 21 nt, Artificial Sequence
  Description of Artificial Sequence: Synthetic oligonucleotide
uccacugguguuuauaggguu

SEQ ID NO: 30661 - RNA, 21 nt, Artificial Sequence
  Description of Artificial Sequence: Synthetic oligonucleotide
ucccacugguguuuauagguu

SEQ ID NO: 30662 - RNA, 21 nt, Artificial Sequence
  Description of Artificial Sequence: Synthetic oligonucleotide
uucccacugguguuuauaguu

SEQ ID NO: 30663 - RNA, 21 nt, Artificial Sequence
  Description of Artificial Sequence: Synthetic oligonucleotide
uuucccacugguguuuauauu

SEQ ID NO: 30664 - RNA, 21 nt, Artificial Sequence
  Description of Artificial Sequence: Synthetic oligonucleotide
ucuucccacugguguuuauuu

SEQ ID NO: 30665 - RNA, 21 nt, Artificial Sequence
  Description of Artificial Sequence: Synthetic oligonucleotide
uccuucccacugguguuuauu

SEQ ID NO: 30666 - RNA, 21 nt, Artificial Sequence
  Description of Artificial Sequence: Synthetic oligonucleotide
ucccuucccacugguguuuuu

SEQ ID NO: 30667 - RNA, 21 nt, Artificial Sequence
  Description of Artificial Sequence: Synthetic oligonucleotide
ugcccuucccacugguguuuu

SEQ ID NO: 30668 - RNA, 21 nt, Artificial Sequence
  Description of Artificial Sequence: Synthetic oligonucleotide
uugcccuucccacugguguuu

SEQ ID NO: 30669 - RNA, 21 nt, Artificial Sequence
  Description of Artificial Sequence: Synthetic oligonucleotide
uuugcccuucccacugguguu

SEQ ID NO: 30670 - RNA, 21 nt, Artificial Sequence
  Description of Artificial Sequence: Synthetic oligonucleotide
uguugcccuucccacugguuu

SEQ ID NO: 30671 - RNA, 21 nt, Artificial Sequence
  Description of Artificial Sequence: Synthetic oligonucleotide
ugguugcccuucccacugguu

SEQ ID NO: 30672 - RNA, 21 nt, Artificial Sequence
  Description of Artificial Sequence: Synthetic oligonucleotide
uggguugcccuucccacuguu

SEQ ID NO: 30673 - RNA, 21 nt, Artificial Sequence
  Description of Artificial Sequence: Synthetic oligonucleotide
uuggguugcccuucccacuuu

SEQ ID NO: 30674 - RNA, 21 nt, Artificial Sequence
  Description of Artificial Sequence: Synthetic oligonucleotide
uguggguugcccuucccacuu

SEQ ID NO: 30675 - RNA, 21 nt, Artificial Sequence
  Description of Artificial Sequence: Synthetic oligonucleotide
uaguggguugcccuucccauu

SEQ ID NO: 30676 - RNA, 21 nt, Artificial Sequence
  Description of Artificial Sequence: Synthetic oligonucleotide
ucaguggguugcccuucccuu

SEQ ID NO: 30677 - RNA, 21 nt, Artificial Sequence
  Description of Artificial Sequence: Synthetic oligonucleotide
ugcaguggguugcccuuccuu

SEQ ID NO: 30678 - RNA, 21 nt, Artificial Sequence
  Description of Artificial Sequence: Synthetic oligonucleotide
uugcaguggguugcccuucuu

SEQ ID NO: 30679 - RNA, 21 nt, Artificial Sequence
  Description of Artificial Sequence: Synthetic oligonucleotide
ugugcaguggguugcccuuuu

SEQ ID NO: 30680 - RNA, 21 nt, Artificial Sequence
  Description of Artificial Sequence: Synthetic oligonucleotide
ucgugcaguggguugcccuuu

SEQ ID NO: 30681 - RNA, 21 nt, Artificial Sequence
  Description of Artificial Sequence: Synthetic oligonucleotide
uacgugcaguggguugcccuu

SEQ ID NO: 30682 - RNA, 21 nt, Artificial Sequence
  Description of Artificial Sequence: Synthetic oligonucleotide
ucacgugcaguggguugccuu

SEQ ID NO: 30683 - RNA, 21 nt, Artificial Sequence
  Description of Artificial Sequence: Synthetic oligonucleotide
uccacgugcaguggguugcuu

SEQ ID NO: 30684 - RNA, 21 nt, Artificial Sequence
  Description of Artificial Sequence: Synthetic oligonucleotide
ucccacgugcaguggguuguu

SEQ ID NO: 30685 - RNA, 21 nt, Artificial Sequence
  Description of Artificial Sequence: Synthetic oligonucleotide
uucccacgugcaguggguuuu

SEQ ID NO: 30686 - RNA, 21 nt, Artificial Sequence
  Description of Artificial Sequence: Synthetic oligonucleotide
uuucccacgugcaguggguuu

SEQ ID NO: 30687 - RNA, 21 nt, Artificial Sequence
  Description of Artificial Sequence: Synthetic oligonucleotide
uauucccacgugcaguggguu

SEQ ID NO: 30688 - RNA, 21 nt, Artificial Sequence
  Description of Artificial Sequence: Synthetic oligonucleotide
ucauucccacgugcagugguu

SEQ ID NO: 30689 - RNA, 21 nt, Artificial Sequence
  Description of Artificial Sequence: Synthetic oligonucleotide
ugcauucccacgugcaguguu

SEQ ID NO: 30690 - RNA, 21 nt, Artificial Sequence
  Description of Artificial Sequence: Synthetic oligonucleotide
uugcauucccacgugcaguuu

SEQ ID NO: 30691 - RNA, 21 nt, Artificial Sequence
  Description of Artificial Sequence: Synthetic oligonucleotide
ugugcauucccacgugcaguu

SEQ ID NO: 30692 - RNA, 21 nt, Artificial Sequence
  Description of Artificial Sequence: Synthetic oligonucleotide
uagugcauucccacgugcauu

SEQ ID NO: 30693 - RNA, 21 nt, Artificial Sequence
  Description of Artificial Sequence: Synthetic oligonucleotide
ucagugcauucccacgugcuu

SEQ ID NO: 30694 - RNA, 21 nt, Artificial Sequence
  Description of Artificial Sequence: Synthetic oligonucleotide
uucagugcauucccacguguu

SEQ ID NO: 30695 - RNA, 21 nt, Artificial Sequence
  Description of Artificial Sequence: Synthetic oligonucleotide
uaucagugcauucccacguuu

SEQ ID NO: 30696 - RNA, 21 nt, Artificial Sequence
  Description of Artificial Sequence: Synthetic oligonucleotide
uaaucagugcauucccacguu

SEQ ID NO: 30697 - RNA, 21 nt, Artificial Sequence
  Description of Artificial Sequence: Synthetic oligonucleotide
uaaaucagugcauucccacuu

SEQ ID NO: 30698 - RNA, 21 nt, Artificial Sequence
  Description of Artificial Sequence: Synthetic oligonucleotide
uaaaaucagugcauucccauu

SEQ ID NO: 30699 - RNA, 21 nt, Artificial Sequence
  Description of Artificial Sequence: Synthetic oligonucleotide
uaaaaaucagugcauucccuu

SEQ ID NO: 30700 - RNA, 21 nt, Artificial Sequence
  Description of Artificial Sequence: Synthetic oligonucleotide
ugaaaaaucagugcauuccuu

SEQ ID NO: 30701 - RNA, 21 nt, Artificial Sequence
  Description of Artificial Sequence: Synthetic oligonucleotide
uggaaaaaucagugcauucuu

SEQ ID NO: 30702 - RNA, 21 nt, Artificial Sequence
  Description of Artificial Sequence: Synthetic oligonucleotide
uaggaaaaaucagugcauuuu

SEQ ID NO: 30703 - RNA, 21 nt, Artificial Sequence
  Description of Artificial Sequence: Synthetic oligonucleotide
uuaggaaaaaucagugcauuu

SEQ ID NO: 30704 - RNA, 21 nt, Artificial Sequence
  Description of Artificial Sequence: Synthetic oligonucleotide
ucuaggaaaaaucagugcauu

SEQ ID NO: 30705 - RNA, 21 nt, Artificial Sequence
  Description of Artificial Sequence: Synthetic oligonucleotide
uccuaggaaaaaucagugcuu

SEQ ID NO: 30706 - RNA, 21 nt, Artificial Sequence
  Description of Artificial Sequence: Synthetic oligonucleotide
uuccuaggaaaaaucaguguu

SEQ ID NO: 30707 - RNA, 21 nt, Artificial Sequence
  Description of Artificial Sequence: Synthetic oligonucleotide
ucuccuaggaaaaaucaguuu

SEQ ID NO: 30708 - RNA, 21 nt, Artificial Sequence
  Description of Artificial Sequence: Synthetic oligonucleotide
uacuccuaggaaaaaucaguu

SEQ ID NO: 30709 - RNA, 21 nt, Artificial Sequence
  Description of Artificial Sequence: Synthetic oligonucleotide
uuacuccuaggaaaaaucauu

SEQ ID NO: 30710 - RNA, 21 nt, Artificial Sequence
  Description of Artificial Sequence: Synthetic oligonucleotide
ucuacuccuaggaaaaaucuu

SEQ ID NO: 30711 - RNA, 21 nt, Artificial Sequence
  Description of Artificial Sequence: Synthetic oligonucleotide
uucuacuccuaggaaaaauuu

SEQ ID NO: 30712 - RNA, 21 nt, Artificial Sequence
  Description of Artificial Sequence: Synthetic oligonucleotide
ugucuacuccuaggaaaaauu

SEQ ID NO: 30713 - RNA, 21 nt, Artificial Sequence
  Description of Artificial Sequence: Synthetic oligonucleotide
uugucuacuccuaggaaaauu

SEQ ID NO: 30714 - RNA, 21 nt, Artificial Sequence
  Description of Artificial Sequence: Synthetic oligonucleotide
uaugucuacuccuaggaaauu

SEQ ID NO: 30715 - RNA, 21 nt, Artificial Sequence
  Description of Artificial Sequence: Synthetic oligonucleotide
ucaugucuacuccuaggaauu

SEQ ID NO: 30716 - RNA, 21 nt, Artificial Sequence
  Description of Artificial Sequence: Synthetic oligonucleotide
uacaugucuacuccuaggauu

SEQ ID NO: 30717 - RNA, 21 nt, Artificial Sequence
  Description of Artificial Sequence: Synthetic oligonucleotide
uaacaugucuacuccuagguu

SEQ ID NO: 30718 - RNA, 21 nt, Artificial Sequence
  Description of Artificial Sequence: Synthetic oligonucleotide
ugaacaugucuacuccuaguu

SEQ ID NO: 30719 - RNA, 21 nt, Artificial Sequence
  Description of Artificial Sequence: Synthetic oligonucleotide
uggaacaugucuacuccuauu

SEQ ID NO: 30720 - RNA, 21 nt, Artificial Sequence
  Description of Artificial Sequence: Synthetic oligonucleotide
uaggaacaugucuacuccuuu

SEQ ID NO: 30721 - RNA, 21 nt, Artificial Sequence
  Description of Artificial Sequence: Synthetic oligonucleotide
ugaggaacaugucuacuccuu

SEQ ID NO: 30722 - RNA, 21 nt, Artificial Sequence
  Description of Artificial Sequence: Synthetic oligonucleotide
uagaggaacaugucuacucuu

SEQ ID NO: 30723 - RNA, 21 nt, Artificial Sequence
  Description of Artificial Sequence: Synthetic oligonucleotide
uuagaggaacaugucuacuuu

SEQ ID NO: 30724 - RNA, 21 nt, Artificial Sequence
  Description of Artificial Sequence: Synthetic oligonucleotide
uuuagaggaacaugucuacuu

SEQ ID NO: 30725 - RNA, 21 nt, Artificial Sequence
  Description of Artificial Sequence: Synthetic oligonucleotide
uauuagaggaacaugucuauu

SEQ ID NO: 30726 - RNA, 21 nt, Artificial Sequence
  Description of Artificial Sequence: Synthetic oligonucleotide
uaauuagaggaacaugucuuu

SEQ ID NO: 30727 - RNA, 21 nt, Artificial Sequence
  Description of Artificial Sequence: Synthetic oligonucleotide
uuaauuagaggaacaugucuu

SEQ ID NO: 30728 - RNA, 21 nt, Artificial Sequence
  Description of Artificial Sequence: Synthetic oligonucleotide
uguaauuagaggaacauguuu

SEQ ID NO: 30729 - RNA, 21 nt, Artificial Sequence
  Description of Artificial Sequence: Synthetic oligonucleotide
uaguaauuagaggaacauguu

SEQ ID NO: 30730 - RNA, 21 nt, Artificial Sequence
  Description of Artificial Sequence: Synthetic oligonucleotide
ugaguaauuagaggaacauuu

SEQ ID NO: 30731 - RNA, 21 nt, Artificial Sequence
  Description of Artificial Sequence: Synthetic oligonucleotide
uggaguaauuagaggaacauu

SEQ ID NO: 30732 - RNA, 21 nt, Artificial Sequence
  Description of Artificial Sequence: Synthetic oligonucleotide
ugggaguaauuagaggaacuu

SEQ ID NO: 30733 - RNA, 21 nt, Artificial Sequence
  Description of Artificial Sequence: Synthetic oligonucleotide
uagggaguaauuagaggaauu

SEQ ID NO: 30734 - RNA, 21 nt, Artificial Sequence
  Description of Artificial Sequence: Synthetic oligonucleotide
ucagggaguaauuagaggauu

SEQ ID NO: 30735 - RNA, 21 nt, Artificial Sequence
  Description of Artificial Sequence: Synthetic oligonucleotide
uucagggaguaauuagagguu

SEQ ID NO: 30736 - RNA, 21 nt, Artificial Sequence
  Description of Artificial Sequence: Synthetic oligonucleotide
ucucagggaguaauuagaguu

SEQ ID NO: 30737 - RNA, 21 nt, Artificial Sequence
  Description of Artificial Sequence: Synthetic oligonucleotide
uccucagggaguaauuagauu

SEQ ID NO: 30738 - RNA, 21 nt, Artificial Sequence
  Description of Artificial Sequence: Synthetic oligonucleotide
ucccucagggaguaauuaguu

SEQ ID NO: 30739 - RNA, 21 nt, Artificial Sequence
  Description of Artificial Sequence: Synthetic oligonucleotide
uacccucagggaguaauuauu

SEQ ID NO: 30740 - RNA, 21 nt, Artificial Sequence
  Description of Artificial Sequence: Synthetic oligonucleotide
uaacccucagggaguaauuuu

SEQ ID NO: 30741 - RNA, 21 nt, Artificial Sequence
  Description of Artificial Sequence: Synthetic oligonucleotide
uuaacccucagggaguaauuu

SEQ ID NO: 30742 - RNA, 21 nt, Artificial Sequence
  Description of Artificial Sequence: Synthetic oligonucleotide
ucuaacccucagggaguaauu

SEQ ID NO: 30743 - RNA, 21 nt, Artificial Sequence
  Description of Artificial Sequence: Synthetic oligonucleotide
uacuaacccucagggaguauu

SEQ ID NO: 30744 - RNA, 21 nt, Artificial Sequence
  Description of Artificial Sequence: Synthetic oligonucleotide
uaacuaacccucagggaguuu

SEQ ID NO: 30745 - RNA, 21 nt, Artificial Sequence
  Description of Artificial Sequence: Synthetic oligonucleotide
ucaacuaacccucagggaguu

SEQ ID NO: 30746 - RNA, 21 nt, Artificial Sequence
  Description of Artificial Sequence: Synthetic oligonucleotide
uccaacuaacccucagggauu

SEQ ID NO: 30747 - RNA, 21 nt, Artificial Sequence
  Description of Artificial Sequence: Synthetic oligonucleotide
ucccaacuaacccucaggguu

SEQ ID NO: 30748 - RNA, 21 nt, Artificial Sequence
  Description of Artificial Sequence: Synthetic oligonucleotide
uccccaacuaacccucagguu

SEQ ID NO: 30749 - RNA, 21 nt, Artificial Sequence
  Description of Artificial Sequence: Synthetic oligonucleotide
ugccccaacuaacccucaguu

SEQ ID NO: 30750 - RNA, 21 nt, Artificial Sequence
  Description of Artificial Sequence: Synthetic oligonucleotide
uagccccaacuaacccucauu

SEQ ID NO: 30751 - RNA, 21 nt, Artificial Sequence
  Description of Artificial Sequence: Synthetic oligonucleotide
uuagccccaacuaacccucuu

SEQ ID NO: 30752 - RNA, 21 nt, Artificial Sequence
  Description of Artificial Sequence: Synthetic oligonucleotide
uuuagccccaacuaacccuuu

SEQ ID NO: 30753 - RNA, 21 nt, Artificial Sequence
  Description of Artificial Sequence: Synthetic oligonucleotide
uuuuagccccaacuaacccuu

SEQ ID NO: 30754 - RNA, 21 nt, Artificial Sequence
  Description of Artificial Sequence: Synthetic oligonucleotide
uguuuagccccaacuaaccuu

SEQ ID NO: 30755 - RNA, 21 nt, Artificial Sequence
  Description of Artificial Sequence: Synthetic oligonucleotide
ugguuuagccccaacuaacuu

SEQ ID NO: 30756 - RNA, 21 nt, Artificial Sequence
  Description of Artificial Sequence: Synthetic oligonucleotide
uugguuuagccccaacuaauu

SEQ ID NO: 30757 - RNA, 21 nt, Artificial Sequence
  Description of Artificial Sequence: Synthetic oligonucleotide
uaugguuuagccccaacuauu

SEQ ID NO: 30758 - RNA, 21 nt, Artificial Sequence
  Description of Artificial Sequence: Synthetic oligonucleotide
ucaugguuuagccccaacuuu

SEQ ID NO: 30759 - RNA, 21 nt, Artificial Sequence
  Description of Artificial Sequence: Synthetic oligonucleotide
uucaugguuuagccccaacuu

SEQ ID NO: 30760 - RNA, 21 nt, Artificial Sequence
  Description of Artificial Sequence: Synthetic oligonucleotide
ugucaugguuuagccccaauu

SEQ ID NO: 30761 - RNA, 21 nt, Artificial Sequence
  Description of Artificial Sequence: Synthetic oligonucleotide
uugucaugguuuagccccauu

SEQ ID NO: 30762 - RNA, 21 nt, Artificial Sequence
  Description of Artificial Sequence: Synthetic oligonucleotide
ucugucaugguuuagccccuu

SEQ ID NO: 30763 - RNA, 21 nt, Artificial Sequence
  Description of Artificial Sequence: Synthetic oligonucleotide
uucugucaugguuuagcccuu

SEQ ID NO: 30764 - RNA, 21 nt, Artificial Sequence
  Description of Artificial Sequence: Synthetic oligonucleotide
uuucugucaugguuuagccuu

SEQ ID NO: 30765 - RNA, 21 nt, Artificial Sequence
  Description of Artificial Sequence: Synthetic oligonucleotide
ucuucugucaugguuuagcuu

SEQ ID NO: 30766 - RNA, 21 nt, Artificial Sequence
  Description of Artificial Sequence: Synthetic oligonucleotide
uacuucugucaugguuuaguu

SEQ ID NO: 30767 - RNA, 21 nt, Artificial Sequence
  Description of Artificial Sequence: Synthetic oligonucleotide
ucacuucugucaugguuuauu

SEQ ID NO: 30768 - RNA, 21 nt, Artificial Sequence
  Description of Artificial Sequence: Synthetic oligonucleotide
uccacuucugucaugguuuuu

SEQ ID NO: 30769 - RNA, 21 nt, Artificial Sequence
  Description of Artificial Sequence: Synthetic oligonucleotide
ucccacuucugucaugguuuu

SEQ ID NO: 30770 - RNA, 21 nt, Artificial Sequence
  Description of Artificial Sequence: Synthetic oligonucleotide
uccccacuucugucaugguuu

SEQ ID NO: 30771 - RNA, 21 nt, Artificial Sequence
  Description of Artificial Sequence: Synthetic oligonucleotide
uuccccacuucugucaugguu

SEQ ID NO: 30772 - RNA, 21 nt, Artificial Sequence
  Description of Artificial Sequence: Synthetic oligonucleotide
uuuccccacuucugucauguu

SEQ ID NO: 30773 - RNA, 21 nt, Artificial Sequence
  Description of Artificial Sequence: Synthetic oligonucleotide
ucuuccccacuucugucauuu

SEQ ID NO: 30774 - RNA, 21 nt, Artificial Sequence
  Description of Artificial Sequence: Synthetic oligonucleotide
uacuuccccacuucugucauu

SEQ ID NO: 30775 - RNA, 21 nt, Artificial Sequence
  Description of Artificial Sequence: Synthetic oligonucleotide
uaacuuccccacuucugucuu

SEQ ID NO: 30776 - RNA, 21 nt, Artificial Sequence
  Description of Artificial Sequence: Synthetic oligonucleotide
ugaacuuccccacuucuguuu

SEQ ID NO: 30777 - RNA, 21 nt, Artificial Sequence
  Description of Artificial Sequence: Synthetic oligonucleotide
uugaacuuccccacuucuguu

SEQ ID NO: 30778 - RNA, 21 nt, Artificial Sequence
  Description of Artificial Sequence: Synthetic oligonucleotide
uuugaacuuccccacuucuuu

SEQ ID NO: 30779 - RNA, 21 nt, Artificial Sequence
  Description of Artificial Sequence: Synthetic oligonucleotide
uauugaacuuccccacuucuu

SEQ ID NO: 30780 - RNA, 21 nt, Artificial Sequence
  Description of Artificial Sequence: Synthetic oligonucleotide
ucauugaacuuccccacuuuu

SEQ ID NO: 30781 - RNA, 21 nt, Artificial Sequence
  Description of Artificial Sequence: Synthetic oligonucleotide
uacauugaacuuccccacuuu

SEQ ID NO: 30782 - RNA, 21 nt, Artificial Sequence
  Description of Artificial Sequence: Synthetic oligonucleotide
ugacauugaacuuccccacuu

SEQ ID NO: 30783 - RNA, 21 nt, Artificial Sequence
  Description of Artificial Sequence: Synthetic oligonucleotide
uggacauugaacuuccccauu

SEQ ID NO: 30784 - RNA, 21 nt, Artificial Sequence
  Description of Artificial Sequence: Synthetic oligonucleotide
uaggacauugaacuuccccuu

SEQ ID NO: 30785 - RNA, 21 nt, Artificial Sequence
  Description of Artificial Sequence: Synthetic oligonucleotide
uaaggacauugaacuucccuu

SEQ ID NO: 30786 - RNA, 21 nt, Artificial Sequence
  Description of Artificial Sequence: Synthetic oligonucleotide
uuaaggacauugaacuuccuu

SEQ ID NO: 30787 - RNA, 21 nt, Artificial Sequence
  Description of Artificial Sequence: Synthetic oligonucleotide
uuuaaggacauugaacuucuu

SEQ ID NO: 30788 - RNA, 21 nt, Artificial Sequence
  Description of Artificial Sequence: Synthetic oligonucleotide
uuuuaaggacauugaacuuuu

SEQ ID NO: 30789 - RNA, 21 nt, Artificial Sequence
  Description of Artificial Sequence: Synthetic oligonucleotide
uauuuaaggacauugaacuuu

SEQ ID NO: 30790 - RNA, 21 nt, Artificial Sequence
  Description of Artificial Sequence: Synthetic oligonucleotide
ugauuuaaggacauugaacuu

SEQ ID NO: 30791 - RNA, 21 nt, Artificial Sequence
  Description of Artificial Sequence: Synthetic oligonucleotide
uggauuuaaggacauugaauu

SEQ ID NO: 30792 - RNA, 21 nt, Artificial Sequence
  Description of Artificial Sequence: Synthetic oligonucleotide
uuggauuuaaggacauugauu

SEQ ID NO: 30793 - RNA, 21 nt, Artificial Sequence
  Description of Artificial Sequence: Synthetic oligonucleotide
uauggauuuaaggacauuguu

SEQ ID NO: 30794 - RNA, 21 nt, Artificial Sequence
  Description of Artificial Sequence: Synthetic oligonucleotide
ugauggauuuaaggacauuuu

SEQ ID NO: 30795 - RNA, 21 nt, Artificial Sequence
  Description of Artificial Sequence: Synthetic oligonucleotide
uagauggauuuaaggacauuu

SEQ ID NO: 30796 - RNA, 21 nt, Artificial Sequence
  Description of Artificial Sequence: Synthetic oligonucleotide
uaagauggauuuaaggacauu

SEQ ID NO: 30797 - RNA, 21 nt, Artificial Sequence
  Description of Artificial Sequence: Synthetic oligonucleotide
uuaagauggauuuaaggacuu

SEQ ID NO: 30798 - RNA, 21 nt, Artificial Sequence
  Description of Artificial Sequence: Synthetic oligonucleotide
uguaagauggauuuaaggauu

SEQ ID NO: 30799 - RNA, 21 nt, Artificial Sequence
  Description of Artificial Sequence: Synthetic oligonucleotide
uaguaagauggauuuaagguu

SEQ ID NO: 30800 - RNA, 21 nt, Artificial Sequence
  Description of Artificial Sequence: Synthetic oligonucleotide
uaaguaagauggauuuaaguu

SEQ ID NO: 30801 - RNA, 21 nt, Artificial Sequence
  Description of Artificial Sequence: Synthetic oligonucleotide
ucaaguaagauggauuuaauu

SEQ ID NO: 30802 - RNA, 21 nt, Artificial Sequence
  Description of Artificial Sequence: Synthetic oligonucleotide
ugcaaguaagauggauuuauu

SEQ ID NO: 30803 - RNA, 21 nt, Artificial Sequence
  Description of Artificial Sequence: Synthetic oligonucleotide
uggcaaguaagauggauuuuu

SEQ ID NO: 30804 - RNA, 21 nt, Artificial Sequence
  Description of Artificial Sequence: Synthetic oligonucleotide
uuggcaaguaagauggauuuu

SEQ ID NO: 30805 - RNA, 21 nt, Artificial Sequence
  Description of Artificial Sequence: Synthetic oligonucleotide
uuuggcaaguaagauggauuu

SEQ ID NO: 30806 - RNA, 21 nt, Artificial Sequence
  Description of Artificial Sequence: Synthetic oligonucleotide
uguuggcaaguaagauggauu

SEQ ID NO: 30807 - RNA, 21 nt, Artificial Sequence
  Description of Artificial Sequence: Synthetic oligonucleotide
uuguuggcaaguaagaugguu

SEQ ID NO: 30808 - RNA, 21 nt, Artificial Sequence
  Description of Artificial Sequence: Synthetic oligonucleotide
ucuguuggcaaguaagauguu

SEQ ID NO: 30809 - RNA, 21 nt, Artificial Sequence
  Description of Artificial Sequence: Synthetic oligonucleotide
uccuguuggcaaguaagauuu

SEQ ID NO: 30810 - RNA, 21 nt, Artificial Sequence
  Description of Artificial Sequence: Synthetic oligonucleotide
uaccuguuggcaaguaagauu

SEQ ID NO: 30811 - RNA, 21 nt, Artificial Sequence
  Description of Artificial Sequence: Synthetic oligonucleotide
uuaccuguuggcaaguaaguu

SEQ ID NO: 30812 - RNA, 21 nt, Artificial Sequence
  Description of Artificial Sequence: Synthetic oligonucleotide
uuuaccuguuggcaaguaauu

SEQ ID NO: 30813 - RNA, 21 nt, Artificial Sequence
  Description of Artificial Sequence: Synthetic oligonucleotide
ucuuaccuguuggcaaguauu

SEQ ID NO: 30814 - RNA, 21 nt, Artificial Sequence
  Description of Artificial Sequence: Synthetic oligonucleotide
uucuuaccuguuggcaaguuu

SEQ ID NO: 30815 - RNA, 21 nt, Artificial Sequence
  Description of Artificial Sequence: Synthetic oligonucleotide
ucucuuaccuguuggcaaguu

SEQ ID NO: 30816 - RNA, 21 nt, Artificial Sequence
  Description of Artificial Sequence: Synthetic oligonucleotide
uccucuuaccuguuggcaauu

SEQ ID NO: 30817 - RNA, 21 nt, Artificial Sequence
  Description of Artificial Sequence: Synthetic oligonucleotide
uuccucuuaccuguuggcauu

SEQ ID NO: 30818 - RNA, 21 nt, Artificial Sequence
  Description of Artificial Sequence: Synthetic oligonucleotide
uuuccucuuaccuguuggcuu

SEQ ID NO: 30819 - RNA, 21 nt, Artificial Sequence
  Description of Artificial Sequence: Synthetic oligonucleotide
ucuuccucuuaccuguugguu

SEQ ID NO: 30820 - RNA, 21 nt, Artificial Sequence
  Description of Artificial Sequence: Synthetic oligonucleotide
ugcuuccucuuaccuguuguu

SEQ ID NO: 30821 - RNA, 21 nt, Artificial Sequence
  Description of Artificial Sequence: Synthetic oligonucleotide
uagcuuccucuuaccuguuuu

SEQ ID NO: 30822 - RNA, 21 nt, Artificial Sequence
  Description of Artificial Sequence: Synthetic oligonucleotide
uaagcuuccucuuaccuguuu

SEQ ID NO: 30823 - RNA, 21 nt, Artificial Sequence
  Description of Artificial Sequence: Synthetic oligonucleotide
uuaagcuuccucuuaccuguu

SEQ ID NO: 30824 - RNA, 21 nt, Artificial Sequence
  Description of Artificial Sequence: Synthetic oligonucleotide
uguaagcuuccucuuaccuuu

SEQ ID NO: 30825 - RNA, 21 nt, Artificial Sequence
  Description of Artificial Sequence: Synthetic oligonucleotide
uuguaagcuuccucuuaccuu

SEQ ID NO: 30826 - RNA, 21 nt, Artificial Sequence
  Description of Artificial Sequence: Synthetic oligonucleotide
uauguaagcuuccucuuacuu

SEQ ID NO: 30827 - RNA, 21 nt, Artificial Sequence
  Description of Artificial Sequence: Synthetic oligonucleotide
uaauguaagcuuccucuuauu

SEQ ID NO: 30828 - RNA, 21 nt, Artificial Sequence
  Description of Artificial Sequence: Synthetic oligonucleotide
uuaauguaagcuuccucuuuu

SEQ ID NO: 30829 - RNA, 21 nt, Artificial Sequence
  Description of Artificial Sequence: Synthetic oligonucleotide
uguaauguaagcuuccucuuu

SEQ ID NO: 30830 - RNA, 21 nt, Artificial Sequence
  Description of Artificial Sequence: Synthetic oligonucleotide
uuguaauguaagcuuccucuu

SEQ ID NO: 30831 - RNA, 21 nt, Artificial Sequence
  Description of Artificial Sequence: Synthetic oligonucleotide
uauguaauguaagcuuccuuu

SEQ ID NO: 30832 - RNA, 21 nt, Artificial Sequence
  Description of Artificial Sequence: Synthetic oligonucleotide
ucauguaauguaagcuuccuu

SEQ ID NO: 30833 - RNA, 21 nt, Artificial Sequence
  Description of Artificial Sequence: Synthetic oligonucleotide
uacauguaauguaagcuucuu

SEQ ID NO: 30834 - RNA, 21 nt, Artificial Sequence
  Description of Artificial Sequence: Synthetic oligonucleotide
ugacauguaauguaagcuuuu

SEQ ID NO: 30835 - RNA, 21 nt, Artificial Sequence
  Description of Artificial Sequence: Synthetic oligonucleotide
uggacauguaauguaagcuuu

SEQ ID NO: 30836 - RNA, 21 nt, Artificial Sequence
  Description of Artificial Sequence: Synthetic oligonucleotide
uuggacauguaauguaagcuu

SEQ ID NO: 30837 - RNA, 21 nt, Artificial Sequence
  Description of Artificial Sequence: Synthetic oligonucleotide
ucuggacauguaauguaaguu

SEQ ID NO: 30838 - RNA, 21 nt, Artificial Sequence
  Description of Artificial Sequence: Synthetic oligonucleotide
uacuggacauguaauguaauu

SEQ ID NO: 30839 - RNA, 21 nt, Artificial Sequence
  Description of Artificial Sequence: Synthetic oligonucleotide
ugacuggacauguaauguauu

SEQ ID NO: 30840 - RNA, 21 nt, Artificial Sequence
  Description of Artificial Sequence: Synthetic oligonucleotide
uggacuggacauguaauguuu

SEQ ID NO: 30841 - RNA, 21 nt, Artificial Sequence
  Description of Artificial Sequence: Synthetic oligonucleotide
uuggacuggacauguaauguu

SEQ ID NO: 30842 - RNA, 21 nt, Artificial Sequence
  Description of Artificial Sequence: Synthetic oligonucleotide
uguggacuggacauguaauuu

SEQ ID NO: 30843 - RNA, 21 nt, Artificial Sequence
  Description of Artificial Sequence: Synthetic oligonucleotide
uuguggacuggacauguaauu

SEQ ID NO: 30844 - RNA, 21 nt, Artificial Sequence
  Description of Artificial Sequence: Synthetic oligonucleotide
uauguggacuggacauguauu

SEQ ID NO: 30845 - RNA, 21 nt, Artificial Sequence
  Description of Artificial Sequence: Synthetic oligonucleotide
uaauguggacuggacauguuu

SEQ ID NO: 30846 - RNA, 21 nt, Artificial Sequence
  Description of Artificial Sequence: Synthetic oligonucleotide
uaaauguggacuggacauguu

SEQ ID NO: 30847 - RNA, 21 nt, Artificial Sequence
  Description of Artificial Sequence: Synthetic oligonucleotide
uuaaauguggacuggacauuu

SEQ ID NO: 30848 - RNA, 21 nt, Artificial Sequence
  Description of Artificial Sequence: Synthetic oligonucleotide
uuuaaauguggacuggacauu

SEQ ID NO: 30849 - RNA, 21 nt, Artificial Sequence
  Description of Artificial Sequence: Synthetic oligonucleotide
uuuuaaauguggacuggacuu

SEQ ID NO: 30850 - RNA, 21 nt, Artificial Sequence
  Description of Artificial Sequence: Synthetic oligonucleotide
ucuuuaaauguggacuggauu

SEQ ID NO: 30851 - RNA, 21 nt, Artificial Sequence
  Description of Artificial Sequence: Synthetic oligonucleotide
uucuuuaaauguggacugguu

SEQ ID NO: 30852 - RNA, 21 nt, Artificial Sequence
  Description of Artificial Sequence: Synthetic oligonucleotide
ucucuuuaaauguggacuguu

SEQ ID NO: 30853 - RNA, 21 nt, Artificial Sequence
  Description of Artificial Sequence: Synthetic oligonucleotide
ugcucuuuaaauguggacuuu

SEQ ID NO: 30854 - RNA, 21 nt, Artificial Sequence
  Description of Artificial Sequence: Synthetic oligonucleotide
uugcucuuuaaauguggacuu

SEQ ID NO: 30855 - RNA, 21 nt, Artificial Sequence
  Description of Artificial Sequence: Synthetic oligonucleotide
ugugcucuuuaaauguggauu

SEQ ID NO: 30856 - RNA, 21 nt, Artificial Sequence
  Description of Artificial Sequence: Synthetic oligonucleotide
uagugcucuuuaaaugugguu

SEQ ID NO: 30857 - RNA, 21 nt, Artificial Sequence
  Description of Artificial Sequence: Synthetic oligonucleotide
uaagugcucuuuaaauguguu

SEQ ID NO: 30858 - RNA, 21 nt, Artificial Sequence
  Description of Artificial Sequence: Synthetic oligonucleotide
uuaagugcucuuuaaauguuu

SEQ ID NO: 30859 - RNA, 21 nt, Artificial Sequence
  Description of Artificial Sequence: Synthetic oligonucleotide
uguaagugcucuuuaaauguu

SEQ ID NO: 30860 - RNA, 21 nt, Artificial Sequence
  Description of Artificial Sequence: Synthetic oligonucleotide
uaguaagugcucuuuaaauuu

SEQ ID NO: 30861 - RNA, 21 nt, Artificial Sequence
  Description of Artificial Sequence: Synthetic oligonucleotide
ucaguaagugcucuuuaaauu

SEQ ID NO: 30862 - RNA, 21 nt, Artificial Sequence
  Description of Artificial Sequence: Synthetic oligonucleotide
uacaguaagugcucuuuaauu

SEQ ID NO: 30863 - RNA, 21 nt, Artificial Sequence
  Description of Artificial Sequence: Synthetic oligonucleotide
ucacaguaagugcucuuuauu

SEQ ID NO: 30864 - RNA, 21 nt, Artificial Sequence
  Description of Artificial Sequence: Synthetic oligonucleotide
uccacaguaagugcucuuuuu

SEQ ID NO: 30865 - RNA, 21 nt, Artificial Sequence
  Description of Artificial Sequence: Synthetic oligonucleotide
uuccacaguaagugcucuuuu

SEQ ID NO: 30866 - RNA, 21 nt, Artificial Sequence
  Description of Artificial Sequence: Synthetic oligonucleotide
uuuccacaguaagugcucuuu

SEQ ID NO: 30867 - RNA, 21 nt, Artificial Sequence
  Description of Artificial Sequence: Synthetic oligonucleotide
uguuccacaguaagugcucuu

SEQ ID NO: 30868 - RNA, 21 nt, Artificial Sequence
  Description of Artificial Sequence: Synthetic oligonucleotide
uuguuccacaguaagugcuuu

SEQ ID NO: 30869 - RNA, 21 nt, Artificial Sequence
  Description of Artificial Sequence: Synthetic oligonucleotide
uuuguuccacaguaagugcuu

SEQ ID NO: 30870 - RNA, 21 nt, Artificial Sequence
  Description of Artificial Sequence: Synthetic oligonucleotide
ucuuguuccacaguaaguguu

SEQ ID NO: 30871 - RNA, 21 nt, Artificial Sequence
  Description of Artificial Sequence: Synthetic oligonucleotide
ugcuuguuccacaguaaguuu

SEQ ID NO: 30872 - RNA, 21 nt, Artificial Sequence
  Description of Artificial Sequence: Synthetic oligonucleotide
uggcuuguuccacaguaaguu

SEQ ID NO: 30873 - RNA, 21 nt, Artificial Sequence
  Description of Artificial Sequence: Synthetic oligonucleotide
uaggcuuguuccacaguaauu

SEQ ID NO: 30874 - RNA, 21 nt, Artificial Sequence
  Description of Artificial Sequence: Synthetic oligonucleotide
uaaggcuuguuccacaguauu

SEQ ID NO: 30875 - RNA, 21 nt, Artificial Sequence
  Description of Artificial Sequence: Synthetic oligonucleotide
ugaaggcuuguuccacaguuu

SEQ ID NO: 30876 - RNA, 21 nt, Artificial Sequence
  Description of Artificial Sequence: Synthetic oligonucleotide
uugaaggcuuguuccacaguu

SEQ ID NO: 30877 - RNA, 21 nt, Artificial Sequence
  Description of Artificial Sequence: Synthetic oligonucleotide
ucugaaggcuuguuccacauu

SEQ ID NO: 30878 - RNA, 21 nt, Artificial Sequence
  Description of Artificial Sequence: Synthetic oligonucleotide
ugcugaaggcuuguuccacuu

SEQ ID NO: 30879 - RNA, 21 nt, Artificial Sequence
  Description of Artificial Sequence: Synthetic oligonucleotide
uggcugaaggcuuguuccauu

SEQ ID NO: 30880 - RNA, 21 nt, Artificial Sequence
  Description of Artificial Sequence: Synthetic oligonucleotide
uuggcugaaggcuuguuccuu

SEQ ID NO: 30881 - RNA, 21 nt, Artificial Sequence
  Description of Artificial Sequence: Synthetic oligonucleotide
uuuggcugaaggcuuguucuu

SEQ ID NO: 30882 - RNA, 21 nt, Artificial Sequence
  Description of Artificial Sequence: Synthetic oligonucleotide
uuuuggcugaaggcuuguuuu

SEQ ID NO: 30883 - RNA, 21 nt, Artificial Sequence
  Description of Artificial Sequence: Synthetic oligonucleotide
uguuuggcugaaggcuuguuu

SEQ ID NO: 30884 - RNA, 21 nt, Artificial Sequence
  Description of Artificial Sequence: Synthetic oligonucleotide
uuguuuggcugaaggcuuguu

SEQ ID NO: 30885 - RNA, 21 nt, Artificial Sequence
  Description of Artificial Sequence: Synthetic oligonucleotide
uuuguuuggcugaaggcuuuu

SEQ ID NO: 30886 - RNA, 21 nt, Artificial Sequence
  Description of Artificial Sequence: Synthetic oligonucleotide
uauuguuuggcugaaggcuuu

SEQ ID NO: 30887 - RNA, 21 nt, Artificial Sequence
  Description of Artificial Sequence: Synthetic oligonucleotide
ucauuguuuggcugaaggcuu

SEQ ID NO: 30888 - RNA, 21 nt, Artificial Sequence
  Description of Artificial Sequence: Synthetic oligonucleotide
uccauuguuuggcugaagguu

SEQ ID NO: 30889 - RNA, 21 nt, Artificial Sequence
  Description of Artificial Sequence: Synthetic oligonucleotide
ucccauuguuuggcugaaguu

SEQ ID NO: 30890 - RNA, 21 nt, Artificial Sequence
  Description of Artificial Sequence: Synthetic oligonucleotide
uccccauuguuuggcugaauu

SEQ ID NO: 30891 - RNA, 21 nt, Artificial Sequence
  Description of Artificial Sequence: Synthetic oligonucleotide
uuccccauuguuuggcugauu

SEQ ID NO: 30892 - RNA, 21 nt, Artificial Sequence
  Description of Artificial Sequence: Synthetic oligonucleotide
uauccccauuguuuggcuguu

SEQ ID NO: 30893 - RNA, 21 nt, Artificial Sequence
  Description of Artificial Sequence: Synthetic oligonucleotide
uuauccccauuguuuggcuuu

SEQ ID NO: 30894 - RNA, 21 nt, Artificial Sequence
  Description of Artificial Sequence: Synthetic oligonucleotide
ucuauccccauuguuuggcuu

SEQ ID NO: 30895 - RNA, 21 nt, Artificial Sequence
  Description of Artificial Sequence: Synthetic oligonucleotide
uucuauccccauuguuugguu

SEQ ID NO: 30896 - RNA, 21 nt, Artificial Sequence
  Description of Artificial Sequence: Synthetic oligonucleotide
uuucuauccccauuguuuguu

SEQ ID NO: 30897 - RNA, 21 nt, Artificial Sequence
  Description of Artificial Sequence: Synthetic oligonucleotide
uuuucuauccccauuguuuuu

SEQ ID NO: 30898 - RNA, 21 nt, Artificial Sequence
  Description of Artificial Sequence: Synthetic oligonucleotide
uuuuucuauccccauuguuuu

SEQ ID NO: 30899 - RNA, 21 nt, Artificial Sequence
  Description of Artificial Sequence: Synthetic oligonucleotide
ucuuuucuauccccauuguuu

SEQ ID NO: 30900 - RNA, 21 nt, Artificial Sequence
  Description of Artificial Sequence: Synthetic oligonucleotide
uacuuuucuauccccauuguu

SEQ ID NO: 30901 - RNA, 21 nt, Artificial Sequence
  Description of Artificial Sequence: Synthetic oligonucleotide
uuacuuuucuauccccauuuu

SEQ ID NO: 30902 - RNA, 21 nt, Artificial Sequence
  Description of Artificial Sequence: Synthetic oligonucleotide
ucuacuuuucuauccccauuu

SEQ ID NO: 30903 - RNA, 21 nt, Artificial Sequence
  Description of Artificial Sequence: Synthetic oligonucleotide
uccuacuuuucuauccccauu

SEQ ID NO: 30904 - RNA, 21 nt, Artificial Sequence
  Description of Artificial Sequence: Synthetic oligonucleotide
uaccuacuuuucuauccccuu

SEQ ID NO: 30905 - RNA, 21 nt, Artificial Sequence
  Description of Artificial Sequence: Synthetic oligonucleotide
uuaccuacuuuucuaucccuu

SEQ ID NO: 30906 - RNA, 21 nt, Artificial Sequence
  Description of Artificial Sequence: Synthetic oligonucleotide
uuuaccuacuuuucuauccuu

SEQ ID NO: 30907 - RNA, 21 nt, Artificial Sequence
  Description of Artificial Sequence: Synthetic oligonucleotide
ucuuaccuacuuuucuaucuu

SEQ ID NO: 30908 - RNA, 21 nt, Artificial Sequence
  Description of Artificial Sequence: Synthetic oligonucleotide
uucuuaccuacuuuucuauuu

SEQ ID NO: 30909 - RNA, 21 nt, Artificial Sequence
  Description of Artificial Sequence: Synthetic oligonucleotide
ugucuuaccuacuuuucuauu

SEQ ID NO: 30910 - RNA, 21 nt, Artificial Sequence
  Description of Artificial Sequence: Synthetic oligonucleotide
uagucuuaccuacuuuucuuu

SEQ ID NO: 30911 - RNA, 21 nt, Artificial Sequence
  Description of Artificial Sequence: Synthetic oligonucleotide
ugagucuuaccuacuuuucuu

SEQ ID NO: 30912 - RNA, 21 nt, Artificial Sequence
  Description of Artificial Sequence: Synthetic oligonucleotide
uugagucuuaccuacuuuuuu

SEQ ID NO: 30913 - RNA, 21 nt, Artificial Sequence
  Description of Artificial Sequence: Synthetic oligonucleotide
ucugagucuuaccuacuuuuu

SEQ ID NO: 30914 - RNA, 21 nt, Artificial Sequence
  Description of Artificial Sequence: Synthetic oligonucleotide
ugcugagucuuaccuacuuuu

SEQ ID NO: 30915 - RNA, 21 nt, Artificial Sequence
  Description of Artificial Sequence: Synthetic oligonucleotide
uggcugagucuuaccuacuuu

SEQ ID NO: 30916 - RNA, 21 nt, Artificial Sequence
  Description of Artificial Sequence: Synthetic oligonucleotide
uaggcugagucuuaccuacuu

SEQ ID NO: 30917 - RNA, 21 nt, Artificial Sequence
  Description of Artificial Sequence: Synthetic oligonucleotide
uaaggcugagucuuaccuauu

SEQ ID NO: 30918 - RNA, 21 nt, Artificial Sequence
  Description of Artificial Sequence: Synthetic oligonucleotide
uaaaggcugagucuuaccuuu

SEQ ID NO: 30919 - RNA, 21 nt, Artificial Sequence
  Description of Artificial Sequence: Synthetic oligonucleotide
ucaaaggcugagucuuaccuu

SEQ ID NO: 30920 - RNA, 21 nt, Artificial Sequence
  Description of Artificial Sequence: Synthetic oligonucleotide
uacaaaggcugagucuuacuu

SEQ ID NO: 30921 - RNA, 21 nt, Artificial Sequence
  Description of Artificial Sequence: Synthetic oligonucleotide
ugacaaaggcugagucuuauu

SEQ ID NO: 30922 - RNA, 21 nt, Artificial Sequence
  Description of Artificial Sequence: Synthetic oligonucleotide
uggacaaaggcugagucuuuu

SEQ ID NO: 30923 - RNA, 21 nt, Artificial Sequence
  Description of Artificial Sequence: Synthetic oligonucleotide
uuggacaaaggcugagucuuu

SEQ ID NO: 30924 - RNA, 21 nt, Artificial Sequence
  Description of Artificial Sequence: Synthetic oligonucleotide
ucuggacaaaggcugagucuu

SEQ ID NO: 30925 - RNA, 21 nt, Artificial Sequence
  Description of Artificial Sequence: Synthetic oligonucleotide
uucuggacaaaggcugaguuu

SEQ ID NO: 30926 - RNA, 21 nt, Artificial Sequence
  Description of Artificial Sequence: Synthetic oligonucleotide
ucucuggacaaaggcugaguu

SEQ ID NO: 30927 - RNA, 21 nt, Artificial Sequence
  Description of Artificial Sequence: Synthetic oligonucleotide
uucucuggacaaaggcugauu

SEQ ID NO: 30928 - RNA, 21 nt, Artificial Sequence
  Description of Artificial Sequence: Synthetic oligonucleotide
uuucucuggacaaaggcuguu

SEQ ID NO: 30929 - RNA, 21 nt, Artificial Sequence
  Description of Artificial Sequence: Synthetic oligonucleotide
ucuucucuggacaaaggcuuu

SEQ ID NO: 30930 - RNA, 21 nt, Artificial Sequence
  Description of Artificial Sequence: Synthetic oligonucleotide
ugcuucucuggacaaaggcuu

SEQ ID NO: 30931 - RNA, 21 nt, Artificial Sequence
  Description of Artificial Sequence: Synthetic oligonucleotide
uagcuucucuggacaaagguu

SEQ ID NO: 30932 - RNA, 21 nt, Artificial Sequence
  Description of Artificial Sequence: Synthetic oligonucleotide
ugagcuucucuggacaaaguu

SEQ ID NO: 30933 - RNA, 21 nt, Artificial Sequence
  Description of Artificial Sequence: Synthetic oligonucleotide
uugagcuucucuggacaaauu

SEQ ID NO: 30934 - RNA, 21 nt, Artificial Sequence
  Description of Artificial Sequence: Synthetic oligonucleotide
ucugagcuucucuggacaauu

SEQ ID NO: 30935 - RNA, 21 nt, Artificial Sequence
  Description of Artificial Sequence: Synthetic oligonucleotide
uccugagcuucucuggacauu

SEQ ID NO: 30936 - RNA, 21 nt, Artificial Sequence
  Description of Artificial Sequence: Synthetic oligonucleotide
ucccugagcuucucuggacuu

SEQ ID NO: 30937 - RNA, 21 nt, Artificial Sequence
  Description of Artificial Sequence: Synthetic oligonucleotide
uacccugagcuucucuggauu

SEQ ID NO: 30938 - RNA, 21 nt, Artificial Sequence
  Description of Artificial Sequence: Synthetic oligonucleotide
uuacccugagcuucucugguu

SEQ ID NO: 30939 - RNA, 21 nt, Artificial Sequence
  Description of Artificial Sequence: Synthetic oligonucleotide
uauacccugagcuucucuguu

SEQ ID NO: 30940 - RNA, 21 nt, Artificial Sequence
  Description of Artificial Sequence: Synthetic oligonucleotide
uuauacccugagcuucucuuu

SEQ ID NO: 30941 - RNA, 21 nt, Artificial Sequence
  Description of Artificial Sequence: Synthetic oligonucleotide
ucuauacccugagcuucucuu

SEQ ID NO: 30942 - RNA, 21 nt, Artificial Sequence
  Description of Artificial Sequence: Synthetic oligonucleotide
ugcuauacccugagcuucuuu

SEQ ID NO: 30943 - RNA, 21 nt, Artificial Sequence
  Description of Artificial Sequence: Synthetic oligonucleotide
uagcuauacccugagcuucuu

SEQ ID NO: 30944 - RNA, 21 nt, Artificial Sequence
  Description of Artificial Sequence: Synthetic oligonucleotide
ucagcuauacccugagcuuuu

SEQ ID NO: 30945 - RNA, 21 nt, Artificial Sequence
  Description of Artificial Sequence: Synthetic oligonucleotide
uucagcuauacccugagcuuu

SEQ ID NO: 30946 - RNA, 21 nt, Artificial Sequence
  Description of Artificial Sequence: Synthetic oligonucleotide
uuucagcuauacccugagcuu

SEQ ID NO: 30947 - RNA, 21 nt, Artificial Sequence
  Description of Artificial Sequence: Synthetic oligonucleotide
uauucagcuauacccugaguu

SEQ ID NO: 30948 - RNA, 21 nt, Artificial Sequence
  Description of Artificial Sequence: Synthetic oligonucleotide
uuauucagcuauacccugauu

SEQ ID NO: 30949 - RNA, 21 nt, Artificial Sequence
  Description of Artificial Sequence: Synthetic oligonucleotide
ucuauucagcuauacccuguu

SEQ ID NO: 30950 - RNA, 21 nt, Artificial Sequence
  Description of Artificial Sequence: Synthetic oligonucleotide
uccuauucagcuauacccuuu

SEQ ID NO: 30951 - RNA, 21 nt, Artificial Sequence
  Description of Artificial Sequence: Synthetic oligonucleotide
ugccuauucagcuauacccuu

SEQ ID NO: 30952 - RNA, 21 nt, Artificial Sequence
  Description of Artificial Sequence: Synthetic oligonucleotide
uugccuauucagcuauaccuu

SEQ ID NO: 30953 - RNA, 21 nt, Artificial Sequence
  Description of Artificial Sequence: Synthetic oligonucleotide
ucugccuauucagcuauacuu

SEQ ID NO: 30954 - RNA, 21 nt, Artificial Sequence
  Description of Artificial Sequence: Synthetic oligonucleotide
uacugccuauucagcuauauu

SEQ ID NO: 30955 - RNA, 21 nt, Artificial Sequence
  Description of Artificial Sequence: Synthetic oligonucleotide
uaacugccuauucagcuauuu

SEQ ID NO: 30956 - RNA, 21 nt, Artificial Sequence
  Description of Artificial Sequence: Synthetic oligonucleotide
uaaacugccuauucagcuauu

SEQ ID NO: 30957 - RNA, 21 nt, Artificial Sequence
  Description of Artificial Sequence: Synthetic oligonucleotide
ugaaacugccuauucagcuuu

SEQ ID NO: 30958 - RNA, 21 nt, Artificial Sequence
  Description of Artificial Sequence: Synthetic oligonucleotide
uagaaacugccuauucagcuu

SEQ ID NO: 30959 - RNA, 21 nt, Artificial Sequence
  Description of Artificial Sequence: Synthetic oligonucleotide
uaagaaacugccuauucaguu

SEQ ID NO: 30960 - RNA, 21 nt, Artificial Sequence
  Description of Artificial Sequence: Synthetic oligonucleotide
uaaagaaacugccuauucauu

SEQ ID NO: 30961 - RNA, 21 nt, Artificial Sequence
  Description of Artificial Sequence: Synthetic oligonucleotide
uaaaagaaacugccuauucuu

SEQ ID NO: 30962 - RNA, 21 nt, Artificial Sequence
  Description of Artificial Sequence: Synthetic oligonucleotide
ucaaaagaaacugccuauuuu

SEQ ID NO: 30963 - RNA, 21 nt, Artificial Sequence
  Description of Artificial Sequence: Synthetic oligonucleotide
uacaaaagaaacugccuauuu

SEQ ID NO: 30964 - RNA, 21 nt, Artificial Sequence
  Description of Artificial Sequence: Synthetic oligonucleotide
ugacaaaagaaacugccuauu

SEQ ID NO: 30965 - RNA, 21 nt, Artificial Sequence
  Description of Artificial Sequence: Synthetic oligonucleotide
uggacaaaagaaacugccuuu

SEQ ID NO: 30966 - RNA, 21 nt, Artificial Sequence
  Description of Artificial Sequence: Synthetic oligonucleotide
uaggacaaaagaaacugccuu

SEQ ID NO: 30967 - RNA, 21 nt, Artificial Sequence
  Description of Artificial Sequence: Synthetic oligonucleotide
ucaggacaaaagaaacugcuu

SEQ ID NO: 30968 - RNA, 21 nt, Artificial Sequence
  Description of Artificial Sequence: Synthetic oligonucleotide
uucaggacaaaagaaacuguu

SEQ ID NO: 30969 - RNA, 21 nt, Artificial Sequence
  Description of Artificial Sequence: Synthetic oligonucleotide
ucucaggacaaaagaaacuuu

SEQ ID NO: 30970 - RNA, 21 nt, Artificial Sequence
  Description of Artificial Sequence: Synthetic oligonucleotide
uccucaggacaaaagaaacuu

SEQ ID NO: 30971 - RNA, 21 nt, Artificial Sequence
  Description of Artificial Sequence: Synthetic oligonucleotide
uuccucaggacaaaagaaauu

SEQ ID NO: 30972 - RNA, 21 nt, Artificial Sequence
  Description of Artificial Sequence: Synthetic oligonucleotide
uuuccucaggacaaaagaauu

SEQ ID NO: 30973 - RNA, 21 nt, Artificial Sequence
  Description of Artificial Sequence: Synthetic oligonucleotide
uuuuccucaggacaaaagauu

SEQ ID NO: 30974 - RNA, 21 nt, Artificial Sequence
  Description of Artificial Sequence: Synthetic oligonucleotide
uuuuuccucaggacaaaaguu

SEQ ID NO: 30975 - RNA, 21 nt, Artificial Sequence
  Description of Artificial Sequence: Synthetic oligonucleotide
uauuuuccucaggacaaaauu

SEQ ID NO: 30976 - RNA, 21 nt, Artificial Sequence
  Description of Artificial Sequence: Synthetic oligonucleotide
ugauuuuccucaggacaaauu

SEQ ID NO: 30977 - RNA, 21 nt, Artificial Sequence
  Description of Artificial Sequence: Synthetic oligonucleotide
uugauuuuccucaggacaauu

SEQ ID NO: 30978 - RNA, 21 nt, Artificial Sequence
  Description of Artificial Sequence: Synthetic oligonucleotide
ucugauuuuccucaggacauu

SEQ ID NO: 30979 - RNA, 21 nt, Artificial Sequence
  Description of Artificial Sequence: Synthetic oligonucleotide
uccugauuuuccucaggacuu

SEQ ID NO: 30980 - RNA, 21 nt, Artificial Sequence
  Description of Artificial Sequence: Synthetic oligonucleotide
uuccugauuuuccucaggauu

SEQ ID NO: 30981 - RNA, 21 nt, Artificial Sequence
  Description of Artificial Sequence: Synthetic oligonucleotide
uguccugauuuuccucagguu

SEQ ID NO: 30982 - RNA, 21 nt, Artificial Sequence
  Description of Artificial Sequence: Synthetic oligonucleotide
uuguccugauuuuccucaguu

SEQ ID NO: 30983 - RNA, 21 nt, Artificial Sequence
  Description of Artificial Sequence: Synthetic oligonucleotide
uauguccugauuuuccucauu

SEQ ID NO: 30984 - RNA, 21 nt, Artificial Sequence
  Description of Artificial Sequence: Synthetic oligonucleotide
ucauguccugauuuuccucuu

SEQ ID NO: 30985 - RNA, 21 nt, Artificial Sequence
  Description of Artificial Sequence: Synthetic oligonucleotide
ugcauguccugauuuuccuuu

SEQ ID NO: 30986 - RNA, 21 nt, Artificial Sequence
  Description of Artificial Sequence: Synthetic oligonucleotide
uggcauguccugauuuuccuu

SEQ ID NO: 30987 - RNA, 21 nt, Artificial Sequence
  Description of Artificial Sequence: Synthetic oligonucleotide
uaggcauguccugauuuucuu

SEQ ID NO: 30988 - RNA, 21 nt, Artificial Sequence
  Description of Artificial Sequence: Synthetic oligonucleotide
ucaggcauguccugauuuuuu

SEQ ID NO: 30989 - RNA, 21 nt, Artificial Sequence
  Description of Artificial Sequence: Synthetic oligonucleotide
ugcaggcauguccugauuuuu

SEQ ID NO: 30990 - RNA, 21 nt, Artificial Sequence
  Description of Artificial Sequence: Synthetic oligonucleotide
uagcaggcauguccugauuuu

SEQ ID NO: 30991 - RNA, 21 nt, Artificial Sequence
  Description of Artificial Sequence: Synthetic oligonucleotide
uaagcaggcauguccugauuu

SEQ ID NO: 30992 - RNA, 21 nt, Artificial Sequence
  Description of Artificial Sequence: Synthetic oligonucleotide
uaaagcaggcauguccugauu

SEQ ID NO: 30993 - RNA, 21 nt, Artificial Sequence
  Description of Artificial Sequence: Synthetic oligonucleotide
ugaaagcaggcauguccuguu

SEQ ID NO: 30994 - RNA, 21 nt, Artificial Sequence
  Description of Artificial Sequence: Synthetic oligonucleotide
uagaaagcaggcauguccuuu

SEQ ID NO: 30995 - RNA, 21 nt, Artificial Sequence
  Description of Artificial Sequence: Synthetic oligonucleotide
uuagaaagcaggcauguccuu

SEQ ID NO: 30996 - RNA, 21 nt, Artificial Sequence
  Description of Artificial Sequence: Synthetic oligonucleotide
uuuagaaagcaggcaugucuu

SEQ ID NO: 30997 - RNA, 21 nt, Artificial Sequence
  Description of Artificial Sequence: Synthetic oligonucleotide
uuuuagaaagcaggcauguuu

SEQ ID NO: 30998 - RNA, 21 nt, Artificial Sequence
  Description of Artificial Sequence: Synthetic oligonucleotide
uuuuuagaaagcaggcauguu

SEQ ID NO: 30999 - RNA, 21 nt, Artificial Sequence
  Description of Artificial Sequence: Synthetic oligonucleotide
uuuuuuagaaagcaggcauuu

SEQ ID NO: 31000 - RNA, 21 nt, Artificial Sequence
  Description of Artificial Sequence: Synthetic oligonucleotide
uauuuuuagaaagcaggcauu

SEQ ID NO: 31001 - RNA, 21 nt, Artificial Sequence
  Description of Artificial Sequence: Synthetic oligonucleotide
ugauuuuuagaaagcaggcuu

SEQ ID NO: 31002 - RNA, 21 nt, Artificial Sequence
  Description of Artificial Sequence: Synthetic oligonucleotide
uagauuuuuagaaagcagguu

SEQ ID NO: 31003 - RNA, 21 nt, Artificial Sequence
  Description of Artificial Sequence: Synthetic oligonucleotide
uaagauuuuuagaaagcaguu

SEQ ID NO: 31004 - RNA, 21 nt, Artificial Sequence
  Description of Artificial Sequence: Synthetic oligonucleotide
ugaagauuuuuagaaagcauu

SEQ ID NO: 31005 - RNA, 21 nt, Artificial Sequence
  Description of Artificial Sequence: Synthetic oligonucleotide
uggaagauuuuuagaaagcuu

SEQ ID NO: 31006 - RNA, 21 nt, Artificial Sequence
  Description of Artificial Sequence: Synthetic oligonucleotide
uaggaagauuuuuagaaaguu

SEQ ID NO: 31007 - RNA, 21 nt, Artificial Sequence
  Description of Artificial Sequence: Synthetic oligonucleotide
ugaggaagauuuuuagaaauu

SEQ ID NO: 31008 - RNA, 21 nt, Artificial Sequence
  Description of Artificial Sequence: Synthetic oligonucleotide
uagaggaagauuuuuagaauu

SEQ ID NO: 31009 - RNA, 21 nt, Artificial Sequence
  Description of Artificial Sequence: Synthetic oligonucleotide
ucagaggaagauuuuuagauu

SEQ ID NO: 31010 - RNA, 21 nt, Artificial Sequence
  Description of Artificial Sequence: Synthetic oligonucleotide
uucagaggaagauuuuuaguu

SEQ ID NO: 31011 - RNA, 21 nt, Artificial Sequence
  Description of Artificial Sequence: Synthetic oligonucleotide
uuucagaggaagauuuuuauu

SEQ ID NO: 31012 - RNA, 21 nt, Artificial Sequence
  Description of Artificial Sequence: Synthetic oligonucleotide
ucuucagaggaagauuuuuuu

SEQ ID NO: 31013 - RNA, 21 nt, Artificial Sequence
  Description of Artificial Sequence: Synthetic oligonucleotide
uucuucagaggaagauuuuuu

SEQ ID NO: 31014 - RNA, 21 nt, Artificial Sequence
  Description of Artificial Sequence: Synthetic oligonucleotide
ugucuucagaggaagauuuuu

SEQ ID NO: 31015 - RNA, 21 nt, Artificial Sequence
  Description of Artificial Sequence: Synthetic oligonucleotide
uggucuucagaggaagauuuu

SEQ ID NO: 31016 - RNA, 21 nt, Artificial Sequence
  Description of Artificial Sequence: Synthetic oligonucleotide
uaggucuucagaggaagauuu

SEQ ID NO: 31017 - RNA, 21 nt, Artificial Sequence
  Description of Artificial Sequence: Synthetic oligonucleotide
ucaggucuucagaggaagauu

SEQ ID NO: 31018 - RNA, 21 nt, Artificial Sequence
  Description of Artificial Sequence: Synthetic oligonucleotide
uucaggucuucagaggaaguu

SEQ ID NO: 31019 - RNA, 21 nt, Artificial Sequence
  Description of Artificial Sequence: Synthetic oligonucleotide
ugucaggucuucagaggaauu

SEQ ID NO: 31020 - RNA, 21 nt, Artificial Sequence
  Description of Artificial Sequence: Synthetic oligonucleotide
uggucaggucuucagaggauu

SEQ ID NO: 31021 - RNA, 21 nt, Artificial Sequence
  Description of Artificial Sequence: Synthetic oligonucleotide
ugggucaggucuucagagguu

SEQ ID NO: 31022 - RNA, 21 nt, Artificial Sequence
  Description of Artificial Sequence: Synthetic oligonucleotide
uugggucaggucuucagaguu

SEQ ID NO: 31023 - RNA, 21 nt, Artificial Sequence
  Description of Artificial Sequence: Synthetic oligonucleotide
uuugggucaggucuucagauu

SEQ ID NO: 31024 - RNA, 21 nt, Artificial Sequence
  Description of Artificial Sequence: Synthetic oligonucleotide
ucuugggucaggucuucaguu

SEQ ID NO: 31025 - RNA, 21 nt, Artificial Sequence
  Description of Artificial Sequence: Synthetic oligonucleotide
ugcuugggucaggucuucauu

SEQ ID NO: 31026 - RNA, 21 nt, Artificial Sequence
  Description of Artificial Sequence: Synthetic oligonucleotide
uagcuugggucaggucuucuu

SEQ ID NO: 31027 - RNA, 21 nt, Artificial Sequence
  Description of Artificial Sequence: Synthetic oligonucleotide
ugagcuugggucaggucuuuu

SEQ ID NO: 31028 - RNA, 21 nt, Artificial Sequence
  Description of Artificial Sequence: Synthetic oligonucleotide
uagagcuugggucaggucuuu

SEQ ID NO: 31029 - RNA, 21 nt, Artificial Sequence
  Description of Artificial Sequence: Synthetic oligonucleotide
uaagagcuugggucaggucuu

SEQ ID NO: 31030 - RNA, 21 nt, Artificial Sequence
  Description of Artificial Sequence: Synthetic oligonucleotide
uuaagagcuugggucagguuu

SEQ ID NO: 31031 - RNA, 21 nt, Artificial Sequence
  Description of Artificial Sequence: Synthetic oligonucleotide
uuuaagagcuugggucagguu

SEQ ID NO: 31032 - RNA, 21 nt, Artificial Sequence
  Description of Artificial Sequence: Synthetic oligonucleotide
uuuuaagagcuugggucaguu

SEQ ID NO: 31033 - RNA, 21 nt, Artificial Sequence
  Description of Artificial Sequence: Synthetic oligonucleotide
uauuuaagagcuugggucauu

SEQ ID NO: 31034 - RNA, 21 nt, Artificial Sequence
  Description of Artificial Sequence: Synthetic oligonucleotide
ucauuuaagagcuugggucuu

SEQ ID NO: 31035 - RNA, 21 nt, Artificial Sequence
  Description of Artificial Sequence: Synthetic oligonucleotide
ugcauuuaagagcuuggguuu

SEQ ID NO: 31036 - RNA, 21 nt, Artificial Sequence
  Description of Artificial Sequence: Synthetic oligonucleotide
uagcauuuaagagcuuggguu

SEQ ID NO: 31037 - RNA, 21 nt, Artificial Sequence
  Description of Artificial Sequence: Synthetic oligonucleotide
uuagcauuuaagagcuugguu

SEQ ID NO: 31038 - RNA, 21 nt, Artificial Sequence
  Description of Artificial Sequence: Synthetic oligonucleotide
uauagcauuuaagagcuuguu

SEQ ID NO: 31039 - RNA, 21 nt, Artificial Sequence
  Description of Artificial Sequence: Synthetic oligonucleotide
uaauagcauuuaagagcuuuu

SEQ ID NO: 31040 - RNA, 21 nt, Artificial Sequence
  Description of Artificial Sequence: Synthetic oligonucleotide
ucaauagcauuuaagagcuuu

SEQ ID NO: 31041 - RNA, 21 nt, Artificial Sequence
  Description of Artificial Sequence: Synthetic oligonucleotide
uacaauagcauuuaagagcuu

SEQ ID NO: 31042 - RNA, 21 nt, Artificial Sequence
  Description of Artificial Sequence: Synthetic oligonucleotide
uuacaauagcauuuaagaguu

SEQ ID NO: 31043 - RNA, 21 nt, Artificial Sequence
  Description of Artificial Sequence: Synthetic oligonucleotide
uuuacaauagcauuuaagauu

SEQ ID NO: 31044 - RNA, 21 nt, Artificial Sequence
  Description of Artificial Sequence: Synthetic oligonucleotide
ucuuacaauagcauuuaaguu

SEQ ID NO: 31045 - RNA, 21 nt, Artificial Sequence
  Description of Artificial Sequence: Synthetic oligonucleotide
uucuuacaauagcauuuaauu

SEQ ID NO: 31046 - RNA, 21 nt, Artificial Sequence
  Description of Artificial Sequence: Synthetic oligonucleotide
ucucuuacaauagcauuuauu

SEQ ID NO: 31047 - RNA, 21 nt, Artificial Sequence
  Description of Artificial Sequence: Synthetic oligonucleotide
uucucuuacaauagcauuuuu

SEQ ID NO: 31048 - RNA, 21 nt, Artificial Sequence
  Description of Artificial Sequence: Synthetic oligonucleotide
uuucucuuacaauagcauuuu

SEQ ID NO: 31049 - RNA, 21 nt, Artificial Sequence
  Description of Artificial Sequence: Synthetic oligonucleotide
uuuucucuuacaauagcauuu

SEQ ID NO: 31050 - RNA, 21 nt, Artificial Sequence
  Description of Artificial Sequence: Synthetic oligonucleotide
uauuucucuuacaauagcauu

SEQ ID NO: 31051 - RNA, 21 nt, Artificial Sequence
  Description of Artificial Sequence: Synthetic oligonucleotide
uaauuucucuuacaauagcuu

SEQ ID NO: 31052 - RNA, 21 nt, Artificial Sequence
  Description of Artificial Sequence: Synthetic oligonucleotide
uaaauuucucuuacaauaguu

SEQ ID NO: 31053 - RNA, 21 nt, Artificial Sequence
  Description of Artificial Sequence: Synthetic oligonucleotide
ugaaauuucucuuacaauauu

SEQ ID NO: 31054 - RNA, 21 nt, Artificial Sequence
  Description of Artificial Sequence: Synthetic oligonucleotide
uagaaauuucucuuacaauuu

SEQ ID NO: 31055 - RNA, 21 nt, Artificial Sequence
  Description of Artificial Sequence: Synthetic oligonucleotide
uaagaaauuucucuuacaauu

SEQ ID NO: 31056 - RNA, 21 nt, Artificial Sequence
  Description of Artificial Sequence: Synthetic oligonucleotide
uaaagaaauuucucuuacauu

SEQ ID NO: 31057 - RNA, 21 nt, Artificial Sequence
  Description of Artificial Sequence: Synthetic oligonucleotide
ucaaagaaauuucucuuacuu

SEQ ID NO: 31058 - RNA, 21 nt, Artificial Sequence
  Description of Artificial Sequence: Synthetic oligonucleotide
uacaaagaaauuucucuuauu

SEQ ID NO: 31059 - RNA, 21 nt, Artificial Sequence
  Description of Artificial Sequence: Synthetic oligonucleotide
ugacaaagaaauuucucuuuu

SEQ ID NO: 31060 - RNA, 21 nt, Artificial Sequence
  Description of Artificial Sequence: Synthetic oligonucleotide
uagacaaagaaauuucucuuu

SEQ ID NO: 31061 - RNA, 21 nt, Artificial Sequence
  Description of Artificial Sequence: Synthetic oligonucleotide
uuagacaaagaaauuucucuu

SEQ ID NO: 31062 - RNA, 21 nt, Artificial Sequence
  Description of Artificial Sequence: Synthetic oligonucleotide
uauagacaaagaaauuucuuu

SEQ ID NO: 31063 - RNA, 21 nt, Artificial Sequence
  Description of Artificial Sequence: Synthetic oligonucleotide
uaauagacaaagaaauuucuu

SEQ ID NO: 31064 - RNA, 21 nt, Artificial Sequence
  Description of Artificial Sequence: Synthetic oligonucleotide
uuaauagacaaagaaauuuuu

SEQ ID NO: 31065 - RNA, 21 nt, Artificial Sequence
  Description of Artificial Sequence: Synthetic oligonucleotide
uuuaauagacaaagaaauuuu

SEQ ID NO: 31066 - RNA, 21 nt, Artificial Sequence
  Description of Artificial Sequence: Synthetic oligonucleotide
uguuaauagacaaagaaauuu

SEQ ID NO: 31067 - RNA, 21 nt, Artificial Sequence
  Description of Artificial Sequence: Synthetic oligonucleotide
uaguuaauagacaaagaaauu

SEQ ID NO: 31068 - RNA, 21 nt, Artificial Sequence
  Description of Artificial Sequence: Synthetic oligonucleotide
ugaguuaauagacaaagaauu

SEQ ID NO: 31069 - RNA, 21 nt, Artificial Sequence
  Description of Artificial Sequence: Synthetic oligonucleotide
uggaguuaauagacaaagauu

SEQ ID NO: 31070 - RNA, 21 nt, Artificial Sequence
  Description of Artificial Sequence: Synthetic oligonucleotide
uuggaguuaauagacaaaguu

SEQ ID NO: 31071 - RNA, 21 nt, Artificial Sequence
  Description of Artificial Sequence: Synthetic oligonucleotide
uauggaguuaauagacaaauu

SEQ ID NO: 31072 - RNA, 21 nt, Artificial Sequence
  Description of Artificial Sequence: Synthetic oligonucleotide
uaauggaguuaauagacaauu

SEQ ID NO: 31073 - RNA, 21 nt, Artificial Sequence
  Description of Artificial Sequence: Synthetic oligonucleotide
uaaauggaguuaauagacauu

SEQ ID NO: 31074 - RNA, 21 nt, Artificial Sequence
  Description of Artificial Sequence: Synthetic oligonucleotide
uaaaauggaguuaauagacuu

SEQ ID NO: 31075 - RNA, 21 nt, Artificial Sequence
  Description of Artificial Sequence: Synthetic oligonucleotide
uuaaaauggaguuaauagauu

SEQ ID NO: 31076 - RNA, 21 nt, Artificial Sequence
  Description of Artificial Sequence: Synthetic oligonucleotide
ucuaaaauggaguuaauaguu

SEQ ID NO: 31077 - RNA, 21 nt, Artificial Sequence
  Description of Artificial Sequence: Synthetic oligonucleotide
uacuaaaauggaguuaauauu

SEQ ID NO: 31078 - RNA, 21 nt, Artificial Sequence
  Description of Artificial Sequence: Synthetic oligonucleotide
uuacuaaaauggaguuaauuu

SEQ ID NO: 31079 - RNA, 21 nt, Artificial Sequence
  Description of Artificial Sequence: Synthetic oligonucleotide
ucuacuaaaauggaguuaauu

SEQ ID NO: 31080 - RNA, 21 nt, Artificial Sequence
  Description of Artificial Sequence: Synthetic oligonucleotide
uccuacuaaaauggaguuauu

SEQ ID NO: 31081 - RNA, 21 nt, Artificial Sequence
  Description of Artificial Sequence: Synthetic oligonucleotide
ucccuacuaaaauggaguuuu

SEQ ID NO: 31082 - RNA, 21 nt, Artificial Sequence
  Description of Artificial Sequence: Synthetic oligonucleotide
uucccuacuaaaauggaguuu

SEQ ID NO: 31083 - RNA, 21 nt, Artificial Sequence
  Description of Artificial Sequence: Synthetic oligonucleotide
uaucccuacuaaaauggaguu

SEQ ID NO: 31084 - RNA, 21 nt, Artificial Sequence
  Description of Artificial Sequence: Synthetic oligonucleotide
uaaucccuacuaaaauggauu

SEQ ID NO: 31085 - RNA, 21 nt, Artificial Sequence
  Description of Artificial Sequence: Synthetic oligonucleotide
ugaaucccuacuaaaaugguu

SEQ ID NO: 31086 - RNA, 21 nt, Artificial Sequence
  Description of Artificial Sequence: Synthetic oligonucleotide
uugaaucccuacuaaaauguu

SEQ ID NO: 31087 - RNA, 21 nt, Artificial Sequence
  Description of Artificial Sequence: Synthetic oligonucleotide
ugugaaucccuacuaaaauuu

SEQ ID NO: 31088 - RNA, 21 nt, Artificial Sequence
  Description of Artificial Sequence: Synthetic oligonucleotide
uagugaaucccuacuaaaauu

SEQ ID NO: 31089 - RNA, 21 nt, Artificial Sequence
  Description of Artificial Sequence: Synthetic oligonucleotide
ucagugaaucccuacuaaauu

SEQ ID NO: 31090 - RNA, 21 nt, Artificial Sequence
  Description of Artificial Sequence: Synthetic oligonucleotide
uucagugaaucccuacuaauu

SEQ ID NO: 31091 - RNA, 21 nt, Artificial Sequence
  Description of Artificial Sequence: Synthetic oligonucleotide
ugucagugaaucccuacuauu

SEQ ID NO: 31092 - RNA, 21 nt, Artificial Sequence
  Description of Artificial Sequence: Synthetic oligonucleotide
uagucagugaaucccuacuuu

SEQ ID NO: 31093 - RNA, 21 nt, Artificial Sequence
  Description of Artificial Sequence: Synthetic oligonucleotide
uuagucagugaaucccuacuu

SEQ ID NO: 31094 - RNA, 21 nt, Artificial Sequence
  Description of Artificial Sequence: Synthetic oligonucleotide
ucuagucagugaaucccuauu

SEQ ID NO: 31095 - RNA, 21 nt, Artificial Sequence
  Description of Artificial Sequence: Synthetic oligonucleotide
uucuagucagugaaucccuuu

SEQ ID NO: 31096 - RNA, 21 nt, Artificial Sequence
  Description of Artificial Sequence: Synthetic oligonucleotide
uaucuagucagugaaucccuu

SEQ ID NO: 31097 - RNA, 21 nt, Artificial Sequence
  Description of Artificial Sequence: Synthetic oligonucleotide
uaaucuagucagugaauccuu

SEQ ID NO: 31098 - RNA, 21 nt, Artificial Sequence
  Description of Artificial Sequence: Synthetic oligonucleotide
uaaaucuagucagugaaucuu

SEQ ID NO: 31099 - RNA, 21 nt, Artificial Sequence
  Description of Artificial Sequence: Synthetic oligonucleotide
uaaaaucuagucagugaauuu

SEQ ID NO: 31100 - RNA, 21 nt, Artificial Sequence
  Description of Artificial Sequence: Synthetic oligonucleotide
uuaaaaucuagucagugaauu

SEQ ID NO: 31101 - RNA, 21 nt, Artificial Sequence
  Description of Artificial Sequence: Synthetic oligonucleotide
uguaaaaucuagucagugauu

SEQ ID NO: 31102 - RNA, 21 nt, Artificial Sequence
  Description of Artificial Sequence: Synthetic oligonucleotide
uaguaaaaucuagucaguguu

SEQ ID NO: 31103 - RNA, 21 nt, Artificial Sequence
  Description of Artificial Sequence: Synthetic oligonucleotide
ucaguaaaaucuagucaguuu

SEQ ID NO: 31104 - RNA, 21 nt, Artificial Sequence
  Description of Artificial Sequence: Synthetic oligonucleotide
uucaguaaaaucuagucaguu

SEQ ID NO: 31105 - RNA, 21 nt, Artificial Sequence
  Description of Artificial Sequence: Synthetic oligonucleotide
uuucaguaaaaucuagucauu

SEQ ID NO: 31106 - RNA, 21 nt, Artificial Sequence
  Description of Artificial Sequence: Synthetic oligonucleotide
uguucaguaaaaucuagucuu

SEQ ID NO: 31107 - RNA, 21 nt, Artificial Sequence
  Description of Artificial Sequence: Synthetic oligonucleotide
uaguucaguaaaaucuaguuu

SEQ ID NO: 31108 - RNA, 21 nt, Artificial Sequence
  Description of Artificial Sequence: Synthetic oligonucleotide
uuaguucaguaaaaucuaguu

SEQ ID NO: 31109 - RNA, 21 nt, Artificial Sequence
  Description of Artificial Sequence: Synthetic oligonucleotide
uauaguucaguaaaaucuauu

SEQ ID NO: 31110 - RNA, 21 nt, Artificial Sequence
  Description of Artificial Sequence: Synthetic oligonucleotide
ucauaguucaguaaaaucuuu

SEQ ID NO: 31111 - RNA, 21 nt, Artificial Sequence
  Description of Artificial Sequence: Synthetic oligonucleotide
uucauaguucaguaaaaucuu

SEQ ID NO: 31112 - RNA, 21 nt, Artificial Sequence
  Description of Artificial Sequence: Synthetic oligonucleotide
uuucauaguucaguaaaauuu

SEQ ID NO: 31113 - RNA, 21 nt, Artificial Sequence
  Description of Artificial Sequence: Synthetic oligonucleotide
uuuucauaguucaguaaaauu

SEQ ID NO: 31114 - RNA, 21 nt, Artificial Sequence
  Description of Artificial Sequence: Synthetic oligonucleotide
uuuuucauaguucaguaaauu

SEQ ID NO: 31115 - RNA, 21 nt, Artificial Sequence
  Description of Artificial Sequence: Synthetic oligonucleotide
uauuuucauaguucaguaauu

SEQ ID NO: 31116 - RNA, 21 nt, Artificial Sequence
  Description of Artificial Sequence: Synthetic oligonucleotide
uuauuuucauaguucaguauu

SEQ ID NO: 31117 - RNA, 21 nt, Artificial Sequence
  Description of Artificial Sequence: Synthetic oligonucleotide
uuuauuuucauaguucaguuu

SEQ ID NO: 31118 - RNA, 21 nt, Artificial Sequence
  Description of Artificial Sequence: Synthetic oligonucleotide
uuuuauuuucauaguucaguu

SEQ ID NO: 31119 - RNA, 21 nt, Artificial Sequence
  Description of Artificial Sequence: Synthetic oligonucleotide
uauuuauuuucauaguucauu

SEQ ID NO: 31120 - RNA, 21 nt, Artificial Sequence
  Description of Artificial Sequence: Synthetic oligonucleotide
uuauuuauuuucauaguucuu

SEQ ID NO: 31121 - RNA, 21 nt, Artificial Sequence
  Description of Artificial Sequence: Synthetic oligonucleotide
uguauuuauuuucauaguuuu

SEQ ID NO: 31122 - RNA, 21 nt, Artificial Sequence
  Description of Artificial Sequence: Synthetic oligonucleotide
uuguauuuauuuucauaguuu

SEQ ID NO: 31123 - RNA, 21 nt, Artificial Sequence
  Description of Artificial Sequence: Synthetic oligonucleotide
uguguauuuauuuucauaguu

SEQ ID NO: 31124 - RNA, 21 nt, Artificial Sequence
  Description of Artificial Sequence: Synthetic oligonucleotide
uuguguauuuauuuucauauu

SEQ ID NO: 31125 - RNA, 21 nt, Artificial Sequence
  Description of Artificial Sequence: Synthetic oligonucleotide
uauguguauuuauuuucauuu

SEQ ID NO: 31126 - RNA, 21 nt, Artificial Sequence
  Description of Artificial Sequence: Synthetic oligonucleotide
uuauguguauuuauuuucauu

SEQ ID NO: 31127 - RNA, 21 nt, Artificial Sequence
  Description of Artificial Sequence: Synthetic oligonucleotide
uuuauguguauuuauuuucuu

SEQ ID NO: 31128 - RNA, 21 nt, Artificial Sequence
  Description of Artificial Sequence: Synthetic oligonucleotide
uauuauguguauuuauuuuuu

SEQ ID NO: 31129 - RNA, 21 nt, Artificial Sequence
  Description of Artificial Sequence: Synthetic oligonucleotide
uaauuauguguauuuauuuuu

SEQ ID NO: 31130 - RNA, 21 nt, Artificial Sequence
  Description of Artificial Sequence: Synthetic oligonucleotide
uaaauuauguguauuuauuuu

SEQ ID NO: 31131 - RNA, 21 nt, Artificial Sequence
  Description of Artificial Sequence: Synthetic oligonucleotide
uaaaauuauguguauuuauuu

SEQ ID NO: 31132 - RNA, 21 nt, Artificial Sequence
  Description of Artificial Sequence: Synthetic oligonucleotide
uaaaaauuauguguauuuauu

SEQ ID NO: 31133 - RNA, 21 nt, Artificial Sequence
  Description of Artificial Sequence: Synthetic oligonucleotide
ugaaaaauuauguguauuuuu

SEQ ID NO: 31134 - RNA, 21 nt, Artificial Sequence
  Description of Artificial Sequence: Synthetic oligonucleotide
uugaaaaauuauguguauuuu

SEQ ID NO: 31135 - RNA, 21 nt, Artificial Sequence
  Description of Artificial Sequence: Synthetic oligonucleotide
ugugaaaaauuauguguauuu

SEQ ID NO: 31136 - RNA, 21 nt, Artificial Sequence
  Description of Artificial Sequence: Synthetic oligonucleotide
uugugaaaaauuauguguauu

SEQ ID NO: 31137 - RNA, 21 nt, Artificial Sequence
  Description of Artificial Sequence: Synthetic oligonucleotide
uuugugaaaaauuauguguuu

SEQ ID NO: 31138 - RNA, 21 nt, Artificial Sequence
  Description of Artificial Sequence: Synthetic oligonucleotide
uuuugugaaaaauuauguguu

SEQ ID NO: 31139 - RNA, 21 nt, Artificial Sequence
  Description of Artificial Sequence: Synthetic oligonucleotide
uuuuugugaaaaauuauguuu

SEQ ID NO: 31140 - RNA, 21 nt, Artificial Sequence
  Description of Artificial Sequence: Synthetic oligonucleotide
uauuuugugaaaaauuauguu

SEQ ID NO: 31141 - RNA, 21 nt, Artificial Sequence
  Description of Artificial Sequence: Synthetic oligonucleotide
uaauuuugugaaaaauuauuu

SEQ ID NO: 31142 - RNA, 21 nt, Artificial Sequence
  Description of Artificial Sequence: Synthetic oligonucleotide
uaaauuuugugaaaaauuauu

SEQ ID NO: 31143 - RNA, 21 nt, Artificial Sequence
  Description of Artificial Sequence: Synthetic oligonucleotide
uaaaauuuugugaaaaauuuu

SEQ ID NO: 31144 - RNA, 21 nt, Artificial Sequence
  Description of Artificial Sequence: Synthetic oligonucleotide
ucaaaauuuugugaaaaauuu

SEQ ID NO: 31145 - RNA, 21 nt, Artificial Sequence
  Description of Artificial Sequence: Synthetic oligonucleotide
uccaaaauuuugugaaaaauu

SEQ ID NO: 31146 - RNA, 21 nt, Artificial Sequence
  Description of Artificial Sequence: Synthetic oligonucleotide
ucccaaaauuuugugaaaauu

SEQ ID NO: 31147 - RNA, 21 nt, Artificial Sequence
  Description of Artificial Sequence: Synthetic oligonucleotide
ugcccaaaauuuugugaaauu

SEQ ID NO: 31148 - RNA, 21 nt, Artificial Sequence
  Description of Artificial Sequence: Synthetic oligonucleotide
uggcccaaaauuuugugaauu

SEQ ID NO: 31149 - RNA, 21 nt, Artificial Sequence
  Description of Artificial Sequence: Synthetic oligonucleotide
ugggcccaaaauuuugugauu

SEQ ID NO: 31150 - RNA, 21 nt, Artificial Sequence
  Description of Artificial Sequence: Synthetic oligonucleotide
uugggcccaaaauuuuguguu

SEQ ID NO: 31151 - RNA, 21 nt, Artificial Sequence
  Description of Artificial Sequence: Synthetic oligonucleotide
uuugggcccaaaauuuuguuu

SEQ ID NO: 31152 - RNA, 21 nt, Artificial Sequence
  Description of Artificial Sequence: Synthetic oligonucleotide
uauugggcccaaaauuuuguu

SEQ ID NO: 31153 - RNA, 21 nt, Artificial Sequence
  Description of Artificial Sequence: Synthetic oligonucleotide
uaauugggcccaaaauuuuuu

SEQ ID NO: 31154 - RNA, 21 nt, Artificial Sequence
  Description of Artificial Sequence: Synthetic oligonucleotide
ugaauugggcccaaaauuuuu

SEQ ID NO: 31155 - RNA, 21 nt, Artificial Sequence
  Description of Artificial Sequence: Synthetic oligonucleotide
uggaauugggcccaaaauuuu

SEQ ID NO: 31156 - RNA, 21 nt, Artificial Sequence
  Description of Artificial Sequence: Synthetic oligonucleotide
ugggaauugggcccaaaauuu

SEQ ID NO: 31157 - RNA, 21 nt, Artificial Sequence
  Description of Artificial Sequence: Synthetic oligonucleotide
uggggaauugggcccaaaauu

SEQ ID NO: 31158 - RNA, 21 nt, Artificial Sequence
  Description of Artificial Sequence: Synthetic oligonucleotide
uaggggaauugggcccaaauu

SEQ ID NO: 31159 - RNA, 21 nt, Artificial Sequence
  Description of Artificial Sequence: Synthetic oligonucleotide
uuaggggaauugggcccaauu

SEQ ID NO: 31160 - RNA, 21 nt, Artificial Sequence
  Description of Artificial Sequence: Synthetic oligonucleotide
uuuaggggaauugggcccauu

SEQ ID NO: 31161 - RNA, 21 nt, Artificial Sequence
  Description of Artificial Sequence: Synthetic oligonucleotide
uuuuaggggaauugggcccuu

SEQ ID NO: 31162 - RNA, 21 nt, Artificial Sequence
  Description of Artificial Sequence: Synthetic oligonucleotide
uuuuuaggggaauugggccuu

SEQ ID NO: 31163 - RNA, 21 nt, Artificial Sequence
  Description of Artificial Sequence: Synthetic oligonucleotide
ucuuuuaggggaauugggcuu

SEQ ID NO: 31164 - RNA, 21 nt, Artificial Sequence
  Description of Artificial Sequence: Synthetic oligonucleotide
uucuuuuaggggaauuggguu

SEQ ID NO: 31165 - RNA, 21 nt, Artificial Sequence
  Description of Artificial Sequence: Synthetic oligonucleotide
uuucuuuuaggggaauugguu

SEQ ID NO: 31166 - RNA, 21 nt, Artificial Sequence
  Description of Artificial Sequence: Synthetic oligonucleotide
uauucuuuuaggggaauuguu

SEQ ID NO: 31167 - RNA, 21 nt, Artificial Sequence
  Description of Artificial Sequence: Synthetic oligonucleotide
uaauucuuuuaggggaauuuu

SEQ ID NO: 31168 - RNA, 21 nt, Artificial Sequence
  Description of Artificial Sequence: Synthetic oligonucleotide
ucaauucuuuuaggggaauuu

SEQ ID NO: 31169 - RNA, 21 nt, Artificial Sequence
  Description of Artificial Sequence: Synthetic oligonucleotide
uucaauucuuuuaggggaauu

SEQ ID NO: 31170 - RNA, 21 nt, Artificial Sequence
  Description of Artificial Sequence: Synthetic oligonucleotide
ucucaauucuuuuaggggauu

SEQ ID NO: 31171 - RNA, 21 nt, Artificial Sequence
  Description of Artificial Sequence: Synthetic oligonucleotide
uccucaauucuuuuagggguu

SEQ ID NO: 31172 - RNA, 21 nt, Artificial Sequence
  Description of Artificial Sequence: Synthetic oligonucleotide
uuccucaauucuuuuaggguu

SEQ ID NO: 31173 - RNA, 21 nt, Artificial Sequence
  Description of Artificial Sequence: Synthetic oligonucleotide
uauccucaauucuuuuagguu

SEQ ID NO: 31174 - RNA, 21 nt, Artificial Sequence
  Description of Artificial Sequence: Synthetic oligonucleotide
uaauccucaauucuuuuaguu

SEQ ID NO: 31175 - RNA, 21 nt, Artificial Sequence
  Description of Artificial Sequence: Synthetic oligonucleotide
uuaauccucaauucuuuuauu

SEQ ID NO: 31176 - RNA, 21 nt, Artificial Sequence
  Description of Artificial Sequence: Synthetic oligonucleotide
ucuaauccucaauucuuuuuu

SEQ ID NO: 31177 - RNA, 21 nt, Artificial Sequence
  Description of Artificial Sequence: Synthetic oligonucleotide
uccuaauccucaauucuuuuu

SEQ ID NO: 31178 - RNA, 21 nt, Artificial Sequence
  Description of Artificial Sequence: Synthetic oligonucleotide
ucccuaauccucaauucuuuu

SEQ ID NO: 31179 - RNA, 21 nt, Artificial Sequence
  Description of Artificial Sequence: Synthetic oligonucleotide
uucccuaauccucaauucuuu

SEQ ID NO: 31180 - RNA, 21 nt, Artificial Sequence
  Description of Artificial Sequence: Synthetic oligonucleotide
ucucccuaauccucaauucuu

SEQ ID NO: 31181 - RNA, 21 nt, Artificial Sequence
  Description of Artificial Sequence: Synthetic oligonucleotide
uucucccuaauccucaauuuu

SEQ ID NO: 31182 - RNA, 21 nt, Artificial Sequence
  Description of Artificial Sequence: Synthetic oligonucleotide
uuucucccuaauccucaauuu

SEQ ID NO: 31183 - RNA, 21 nt, Artificial Sequence
  Description of Artificial Sequence: Synthetic oligonucleotide
uuuucucccuaauccucaauu

SEQ ID NO: 31184 - RNA, 21 nt, Artificial Sequence
  Description of Artificial Sequence: Synthetic oligonucleotide
ucuuucucccuaauccucauu

SEQ ID NO: 31185 - RNA, 21 nt, Artificial Sequence
  Description of Artificial Sequence: Synthetic oligonucleotide
uccuuucucccuaauccucuu

SEQ ID NO: 31186 - RNA, 21 nt, Artificial Sequence
  Description of Artificial Sequence: Synthetic oligonucleotide
uuccuuucucccuaauccuuu

SEQ ID NO: 31187 - RNA, 21 nt, Artificial Sequence
  Description of Artificial Sequence: Synthetic oligonucleotide
ucuccuuucucccuaauccuu

SEQ ID NO: 31188 - RNA, 21 nt, Artificial Sequence
  Description of Artificial Sequence: Synthetic oligonucleotide
uucuccuuucucccuaaucuu

SEQ ID NO: 31189 - RNA, 21 nt, Artificial Sequence
  Description of Artificial Sequence: Synthetic oligonucleotide
ugucuccuuucucccuaauuu

SEQ ID NO: 31190 - RNA, 21 nt, Artificial Sequence
  Description of Artificial Sequence: Synthetic oligonucleotide
uugucuccuuucucccuaauu

SEQ ID NO: 31191 - RNA, 21 nt, Artificial Sequence
  Description of Artificial Sequence: Synthetic oligonucleotide
uuugucuccuuucucccuauu

SEQ ID NO: 31192 - RNA, 21 nt, Artificial Sequence
  Description of Artificial Sequence: Synthetic oligonucleotide
uguugucuccuuucucccuuu

SEQ ID NO: 31193 - RNA, 21 nt, Artificial Sequence
  Description of Artificial Sequence: Synthetic oligonucleotide
uaguugucuccuuucucccuu

SEQ ID NO: 31194 - RNA, 21 nt, Artificial Sequence
  Description of Artificial Sequence: Synthetic oligonucleotide
ugaguugucuccuuucuccuu

SEQ ID NO: 31195 - RNA, 21 nt, Artificial Sequence
  Description of Artificial Sequence: Synthetic oligonucleotide
uugaguugucuccuuucucuu

SEQ ID NO: 31196 - RNA, 21 nt, Artificial Sequence
  Description of Artificial Sequence: Synthetic oligonucleotide
uuugaguugucuccuuucuuu

SEQ ID NO: 31197 - RNA, 21 nt, Artificial Sequence
  Description of Artificial Sequence: Synthetic oligonucleotide
uuuugaguugucuccuuucuu

SEQ ID NO: 31198 - RNA, 21 nt, Artificial Sequence
  Description of Artificial Sequence: Synthetic oligonucleotide
ucuuugaguugucuccuuuuu

SEQ ID NO: 31199 - RNA, 21 nt, Artificial Sequence
  Description of Artificial Sequence: Synthetic oligonucleotide
uacuuugaguugucuccuuuu

SEQ ID NO: 31200 - RNA, 21 nt, Artificial Sequence
  Description of Artificial Sequence: Synthetic oligonucleotide
ugacuuugaguugucuccuuu

SEQ ID NO: 31201 - RNA, 21 nt, Artificial Sequence
  Description of Artificial Sequence: Synthetic oligonucleotide
uugacuuugaguugucuccuu

SEQ ID NO: 31202 - RNA, 21 nt, Artificial Sequence
  Description of Artificial Sequence: Synthetic oligonucleotide
uaugacuuugaguugucucuu

SEQ ID NO: 31203 - RNA, 21 nt, Artificial Sequence
  Description of Artificial Sequence: Synthetic oligonucleotide
ugaugacuuugaguugucuuu

SEQ ID NO: 31204 - RNA, 21 nt, Artificial Sequence
  Description of Artificial Sequence: Synthetic oligonucleotide
uggaugacuuugaguugucuu

SEQ ID NO: 31205 - RNA, 21 nt, Artificial Sequence
  Description of Artificial Sequence: Synthetic oligonucleotide
ugggaugacuuugaguuguuu

SEQ ID NO: 31206 - RNA, 21 nt, Artificial Sequence
  Description of Artificial Sequence: Synthetic oligonucleotide
uugggaugacuuugaguuguu

SEQ ID NO: 31207 - RNA, 21 nt, Artificial Sequence
  Description of Artificial Sequence: Synthetic oligonucleotide
uaugggaugacuuugaguuuu

SEQ ID NO: 31208 - RNA, 21 nt, Artificial Sequence
  Description of Artificial Sequence: Synthetic oligonucleotide
uaaugggaugacuuugaguuu

SEQ ID NO: 31209 - RNA, 21 nt, Artificial Sequence
  Description of Artificial Sequence: Synthetic oligonucleotide
uuaaugggaugacuuugaguu

SEQ ID NO: 31210 - RNA, 21 nt, Artificial Sequence
  Description of Artificial Sequence: Synthetic oligonucleotide
uuuaaugggaugacuuugauu

SEQ ID NO: 31211 - RNA, 21 nt, Artificial Sequence
  Description of Artificial Sequence: Synthetic oligonucleotide
ucuuaaugggaugacuuuguu

SEQ ID NO: 31212 - RNA, 21 nt, Artificial Sequence
  Description of Artificial Sequence: Synthetic oligonucleotide
uacuuaaugggaugacuuuuu

SEQ ID NO: 31213 - RNA, 21 nt, Artificial Sequence
  Description of Artificial Sequence: Synthetic oligonucleotide
ucacuuaaugggaugacuuuu

SEQ ID NO: 31214 - RNA, 21 nt, Artificial Sequence
  Description of Artificial Sequence: Synthetic oligonucleotide
ugcacuuaaugggaugacuuu

SEQ ID NO: 31215 - RNA, 21 nt, Artificial Sequence
  Description of Artificial Sequence: Synthetic oligonucleotide
uugcacuuaaugggaugacuu

SEQ ID NO: 31216 - RNA, 21 nt, Artificial Sequence
  Description of Artificial Sequence: Synthetic oligonucleotide
ucugcacuuaaugggaugauu

SEQ ID NO: 31217 - RNA, 21 nt, Artificial Sequence
  Description of Artificial Sequence: Synthetic oligonucleotide
uacugcacuuaaugggauguu

SEQ ID NO: 31218 - RNA, 21 nt, Artificial Sequence
  Description of Artificial Sequence: Synthetic oligonucleotide
uaacugcacuuaaugggauuu

SEQ ID NO: 31219 - RNA, 21 nt, Artificial Sequence
  Description of Artificial Sequence: Synthetic oligonucleotide
uaaacugcacuuaaugggauu

SEQ ID NO: 31220 - RNA, 21 nt, Artificial Sequence
  Description of Artificial Sequence: Synthetic oligonucleotide
ugaaacugcacuuaauggguu

SEQ ID NO: 31221 - RNA, 21 nt, Artificial Sequence
  Description of Artificial Sequence: Synthetic oligonucleotide
uagaaacugcacuuaaugguu

SEQ ID NO: 31222 - RNA, 21 nt, Artificial Sequence
  Description of Artificial Sequence: Synthetic oligonucleotide
uaagaaacugcacuuaauguu

SEQ ID NO: 31223 - RNA, 21 nt, Artificial Sequence
  Description of Artificial Sequence: Synthetic oligonucleotide
uaaagaaacugcacuuaauuu

SEQ ID NO: 31224 - RNA, 21 nt, Artificial Sequence
  Description of Artificial Sequence: Synthetic oligonucleotide
ucaaagaaacugcacuuaauu

SEQ ID NO: 31225 - RNA, 21 nt, Artificial Sequence
  Description of Artificial Sequence: Synthetic oligonucleotide
uucaaagaaacugcacuuauu

SEQ ID NO: 31226 - RNA, 21 nt, Artificial Sequence
  Description of Artificial Sequence: Synthetic oligonucleotide
uuucaaagaaacugcacuuuu

SEQ ID NO: 31227 - RNA, 21 nt, Artificial Sequence
  Description of Artificial Sequence: Synthetic oligonucleotide
uauucaaagaaacugcacuuu

SEQ ID NO: 31228 - RNA, 21 nt, Artificial Sequence
  Description of Artificial Sequence: Synthetic oligonucleotide
ugauucaaagaaacugcacuu

SEQ ID NO: 31229 - RNA, 21 nt, Artificial Sequence
  Description of Artificial Sequence: Synthetic oligonucleotide
uagauucaaagaaacugcauu

SEQ ID NO: 31230 - RNA, 21 nt, Artificial Sequence
  Description of Artificial Sequence: Synthetic oligonucleotide
uaagauucaaagaaacugcuu

SEQ ID NO: 31231 - RNA, 21 nt, Artificial Sequence
  Description of Artificial Sequence: Synthetic oligonucleotide
ugaagauucaaagaaacuguu

SEQ ID NO: 31232 - RNA, 21 nt, Artificial Sequence
  Description of Artificial Sequence: Synthetic oligonucleotide
uagaagauucaaagaaacuuu

SEQ ID NO: 31233 - RNA, 21 nt, Artificial Sequence
  Description of Artificial Sequence: Synthetic oligonucleotide
ucagaagauucaaagaaacuu

SEQ ID NO: 31234 - RNA, 21 nt, Artificial Sequence
  Description of Artificial Sequence: Synthetic oligonucleotide
ugcagaagauucaaagaaauu

SEQ ID NO: 31235 - RNA, 21 nt, Artificial Sequence
  Description of Artificial Sequence: Synthetic oligonucleotide
uagcagaagauucaaagaauu

SEQ ID NO: 31236 - RNA, 21 nt, Artificial Sequence
  Description of Artificial Sequence: Synthetic oligonucleotide
uaagcagaagauucaaagauu

SEQ ID NO: 31237 - RNA, 21 nt, Artificial Sequence
  Description of Artificial Sequence: Synthetic oligonucleotide
uaaagcagaagauucaaaguu

SEQ ID NO: 31238 - RNA, 21 nt, Artificial Sequence
  Description of Artificial Sequence: Synthetic oligonucleotide
uuaaagcagaagauucaaauu

SEQ ID NO: 31239 - RNA, 21 nt, Artificial Sequence
  Description of Artificial Sequence: Synthetic oligonucleotide
uauaaagcagaagauucaauu

SEQ ID NO: 31240 - RNA, 21 nt, Artificial Sequence
  Description of Artificial Sequence: Synthetic oligonucleotide
ugauaaagcagaagauucauu

SEQ ID NO: 31241 - RNA, 21 nt, Artificial Sequence
  Description of Artificial Sequence: Synthetic oligonucleotide
uagauaaagcagaagauucuu

SEQ ID NO: 31242 - RNA, 21 nt, Artificial Sequence
  Description of Artificial Sequence: Synthetic oligonucleotide
uaagauaaagcagaagauuuu

SEQ ID NO: 31243 - RNA, 21 nt, Artificial Sequence
  Description of Artificial Sequence: Synthetic oligonucleotide
uaaagauaaagcagaagauuu

SEQ ID NO: 31244 - RNA, 21 nt, Artificial Sequence
  Description of Artificial Sequence: Synthetic oligonucleotide
uuaaagauaaagcagaagauu

SEQ ID NO: 31245 - RNA, 21 nt, Artificial Sequence
  Description of Artificial Sequence: Synthetic oligonucleotide
uuuaaagauaaagcagaaguu

SEQ ID NO: 31246 - RNA, 21 nt, Artificial Sequence
  Description of Artificial Sequence: Synthetic oligonucleotide
uuuuaaagauaaagcagaauu

SEQ ID NO: 31247 - RNA, 21 nt, Artificial Sequence
  Description of Artificial Sequence: Synthetic oligonucleotide
uuuuuaaagauaaagcagauu

SEQ ID NO: 31248 - RNA, 21 nt, Artificial Sequence
  Description of Artificial Sequence: Synthetic oligonucleotide
uuuuuuaaagauaaagcaguu

SEQ ID NO: 31249 - RNA, 21 nt, Artificial Sequence
  Description of Artificial Sequence: Synthetic oligonucleotide
uauuuuuaaagauaaagcauu

SEQ ID NO: 31250 - RNA, 21 nt, Artificial Sequence
  Description of Artificial Sequence: Synthetic oligonucleotide
uaauuuuuaaagauaaagcuu

SEQ ID NO: 31251 - RNA, 21 nt, Artificial Sequence
  Description of Artificial Sequence: Synthetic oligonucleotide
uaaauuuuuaaagauaaaguu

SEQ ID NO: 31252 - RNA, 21 nt, Artificial Sequence
  Description of Artificial Sequence: Synthetic oligonucleotide
ucaaauuuuuaaagauaaauu

SEQ ID NO: 31253 - RNA, 21 nt, Artificial Sequence
  Description of Artificial Sequence: Synthetic oligonucleotide
uacaaauuuuuaaagauaauu

SEQ ID NO: 31254 - RNA, 21 nt, Artificial Sequence
  Description of Artificial Sequence: Synthetic oligonucleotide
uuacaaauuuuuaaagauauu

SEQ ID NO: 31255 - RNA, 21 nt, Artificial Sequence
  Description of Artificial Sequence: Synthetic oligonucleotide
uauacaaauuuuuaaagauuu

SEQ ID NO: 31256 - RNA, 21 nt, Artificial Sequence
  Description of Artificial Sequence: Synthetic oligonucleotide
uuauacaaauuuuuaaagauu

SEQ ID NO: 31257 - RNA, 21 nt, Artificial Sequence
  Description of Artificial Sequence: Synthetic oligonucleotide
uuuauacaaauuuuuaaaguu

SEQ ID NO: 31258 - RNA, 21 nt, Artificial Sequence
  Description of Artificial Sequence: Synthetic oligonucleotide
uauuauacaaauuuuuaaauu

SEQ ID NO: 31259 - RNA, 21 nt, Artificial Sequence
  Description of Artificial Sequence: Synthetic oligonucleotide
uaauuauacaaauuuuuaauu

SEQ ID NO: 31260 - RNA, 21 nt, Artificial Sequence
  Description of Artificial Sequence: Synthetic oligonucleotide
uaaauuauacaaauuuuuauu

SEQ ID NO: 31261 - RNA, 21 nt, Artificial Sequence
  Description of Artificial Sequence: Synthetic oligonucleotide
uuaaauuauacaaauuuuuuu

SEQ ID NO: 31262 - RNA, 21 nt, Artificial Sequence
  Description of Artificial Sequence: Synthetic oligonucleotide
uauaaauuauacaaauuuuuu

SEQ ID NO: 31263 - RNA, 21 nt, Artificial Sequence
  Description of Artificial Sequence: Synthetic oligonucleotide
uuauaaauuauacaaauuuuu

SEQ ID NO: 31264 - RNA, 21 nt, Artificial Sequence
  Description of Artificial Sequence: Synthetic oligonucleotide
uauauaaauuauacaaauuuu

SEQ ID NO: 31265 - RNA, 21 nt, Artificial Sequence
  Description of Artificial Sequence: Synthetic oligonucleotide
uuauauaaauuauacaaauuu

SEQ ID NO: 31266 - RNA, 21 nt, Artificial Sequence
  Description of Artificial Sequence: Synthetic oligonucleotide
uauauauaaauuauacaaauu

SEQ ID NO: 31267 - RNA, 21 nt, Artificial Sequence
  Description of Artificial Sequence: Synthetic oligonucleotide
uaauauauaaauuauacaauu

SEQ ID NO: 31268 - RNA, 21 nt, Artificial Sequence
  Description of Artificial Sequence: Synthetic oligonucleotide
uaaauauauaaauuauacauu

SEQ ID NO: 31269 - RNA, 21 nt, Artificial Sequence
  Description of Artificial Sequence: Synthetic oligonucleotide
uaaaauauauaaauuauacuu

SEQ ID NO: 31270 - RNA, 21 nt, Artificial Sequence
  Description of Artificial Sequence: Synthetic oligonucleotide
uuaaaauauauaaauuauauu

SEQ ID NO: 31271 - RNA, 21 nt, Artificial Sequence
  Description of Artificial Sequence: Synthetic oligonucleotide
uauaaaauauauaaauuauuu

SEQ ID NO: 31272 - RNA, 21 nt, Artificial Sequence
  Description of Artificial Sequence: Synthetic oligonucleotide
uaauaaaauauauaaauuauu

SEQ ID NO: 31273 - RNA, 21 nt, Artificial Sequence
  Description of Artificial Sequence: Synthetic oligonucleotide
ugaauaaaauauauaaauuuu

SEQ ID NO: 31274 - RNA, 21 nt, Artificial Sequence
  Description of Artificial Sequence: Synthetic oligonucleotide
uagaauaaaauauauaaauuu

SEQ ID NO: 31275 - RNA, 21 nt, Artificial Sequence
  Description of Artificial Sequence: Synthetic oligonucleotide
uuagaauaaaauauauaaauu

SEQ ID NO: 31276 - RNA, 21 nt, Artificial Sequence
  Description of Artificial Sequence: Synthetic oligonucleotide
uauagaauaaaauauauaauu

SEQ ID NO: 31277 - RNA, 21 nt, Artificial Sequence
  Description of Artificial Sequence: Synthetic oligonucleotide
ucauagaauaaaauauauauu

SEQ ID NO: 31278 - RNA, 21 nt, Artificial Sequence
  Description of Artificial Sequence: Synthetic oligonucleotide
uacauagaauaaaauauauuu

SEQ ID NO: 31279 - RNA, 21 nt, Artificial Sequence
  Description of Artificial Sequence: Synthetic oligonucleotide
ucacauagaauaaaauauauu

SEQ ID NO: 31280 - RNA, 21 nt, Artificial Sequence
  Description of Artificial Sequence: Synthetic oligonucleotide
uacacauagaauaaaauauuu

SEQ ID NO: 31281 - RNA, 21 nt, Artificial Sequence
  Description of Artificial Sequence: Synthetic oligonucleotide
uaacacauagaauaaaauauu

SEQ ID NO: 31282 - RNA, 21 nt, Artificial Sequence
  Description of Artificial Sequence: Synthetic oligonucleotide
ugaacacauagaauaaaauuu

SEQ ID NO: 31283 - RNA, 21 nt, Artificial Sequence
  Description of Artificial Sequence: Synthetic oligonucleotide
uggaacacauagaauaaaauu

SEQ ID NO: 31284 - RNA, 21 nt, Artificial Sequence
  Description of Artificial Sequence: Synthetic oligonucleotide
uuggaacacauagaauaaauu

SEQ ID NO: 31285 - RNA, 21 nt, Artificial Sequence
  Description of Artificial Sequence: Synthetic oligonucleotide
uauggaacacauagaauaauu

SEQ ID NO: 31286 - RNA, 21 nt, Artificial Sequence
  Description of Artificial Sequence: Synthetic oligonucleotide
uuauggaacacauagaauauu

SEQ ID NO: 31287 - RNA, 21 nt, Artificial Sequence
  Description of Artificial Sequence: Synthetic oligonucleotide
ucuauggaacacauagaauuu

SEQ ID NO: 31288 - RNA, 21 nt, Artificial Sequence
  Description of Artificial Sequence: Synthetic oligonucleotide
uucuauggaacacauagaauu

SEQ ID NO: 31289 - RNA, 21 nt, Artificial Sequence
  Description of Artificial Sequence: Synthetic oligonucleotide
uaucuauggaacacauagauu

SEQ ID NO: 31290 - RNA, 21 nt, Artificial Sequence
  Description of Artificial Sequence: Synthetic oligonucleotide
uuaucuauggaacacauaguu

SEQ ID NO: 31291 - RNA, 21 nt, Artificial Sequence
  Description of Artificial Sequence: Synthetic oligonucleotide
uauaucuauggaacacauauu

SEQ ID NO: 31292 - RNA, 21 nt, Artificial Sequence
  Description of Artificial Sequence: Synthetic oligonucleotide
ugauaucuauggaacacauuu

SEQ ID NO: 31293 - RNA, 21 nt, Artificial Sequence
  Description of Artificial Sequence: Synthetic oligonucleotide
uagauaucuauggaacacauu

SEQ ID NO: 31294 - RNA, 21 nt, Artificial Sequence
  Description of Artificial Sequence: Synthetic oligonucleotide
uaagauaucuauggaacacuu

SEQ ID NO: 31295 - RNA, 21 nt, Artificial Sequence
  Description of Artificial Sequence: Synthetic oligonucleotide
uuaagauaucuauggaacauu

SEQ ID NO: 31296 - RNA, 21 nt, Artificial Sequence
  Description of Artificial Sequence: Synthetic oligonucleotide
uuuaagauaucuauggaacuu

SEQ ID NO: 31297 - RNA, 21 nt, Artificial Sequence
  Description of Artificial Sequence: Synthetic oligonucleotide
uauuaagauaucuauggaauu

SEQ ID NO: 31298 - RNA, 21 nt, Artificial Sequence
  Description of Artificial Sequence: Synthetic oligonucleotide
ucauuaagauaucuauggauu

SEQ ID NO: 31299 - RNA, 21 nt, Artificial Sequence
  Description of Artificial Sequence: Synthetic oligonucleotide
uacauuaagauaucuaugguu

SEQ ID NO: 31300 - RNA, 21 nt, Artificial Sequence
  Description of Artificial Sequence: Synthetic oligonucleotide
uuacauuaagauaucuauguu

SEQ ID NO: 31301 - RNA, 21 nt, Artificial Sequence
  Description of Artificial Sequence: Synthetic oligonucleotide
uuuacauuaagauaucuauuu

SEQ ID NO: 31302 - RNA, 21 nt, Artificial Sequence
  Description of Artificial Sequence: Synthetic oligonucleotide
uuuuacauuaagauaucuauu

SEQ ID NO: 31303 - RNA, 21 nt, Artificial Sequence
  Description of Artificial Sequence: Synthetic oligonucleotide
uuuuuacauuaagauaucuuu

SEQ ID NO: 31304 - RNA, 21 nt, Artificial Sequence
  Description of Artificial Sequence: Synthetic oligonucleotide
uauuuuacauuaagauaucuu

SEQ ID NO: 31305 - RNA, 21 nt, Artificial Sequence
  Description of Artificial Sequence: Synthetic oligonucleotide
uaauuuuacauuaagauauuu

SEQ ID NO: 31306 - RNA, 21 nt, Artificial Sequence
  Description of Artificial Sequence: Synthetic oligonucleotide
uuaauuuuacauuaagauauu

SEQ ID NO: 31307 - RNA, 21 nt, Artificial Sequence
  Description of Artificial Sequence: Synthetic oligonucleotide
ucuaauuuuacauuaagauuu

SEQ ID NO: 31308 - RNA, 21 nt, Artificial Sequence
  Description of Artificial Sequence: Synthetic oligonucleotide
uacuaauuuuacauuaagauu

SEQ ID NO: 31309 - RNA, 21 nt, Artificial Sequence
  Description of Artificial Sequence: Synthetic oligonucleotide
ugacuaauuuuacauuaaguu

SEQ ID NO: 31310 - RNA, 21 nt, Artificial Sequence
  Description of Artificial Sequence: Synthetic oligonucleotide
uugacuaauuuuacauuaauu

SEQ ID NO: 31311 - RNA, 21 nt, Artificial Sequence
  Description of Artificial Sequence: Synthetic oligonucleotide
uaugacuaauuuuacauuauu

SEQ ID NO: 31312 - RNA, 21 nt, Artificial Sequence
  Description of Artificial Sequence: Synthetic oligonucleotide
uaaugacuaauuuuacauuuu

SEQ ID NO: 31313 - RNA, 21 nt, Artificial Sequence
  Description of Artificial Sequence: Synthetic oligonucleotide
uaaaugacuaauuuuacauuu

SEQ ID NO: 31314 - RNA, 21 nt, Artificial Sequence
  Description of Artificial Sequence: Synthetic oligonucleotide
uuaaaugacuaauuuuacauu

SEQ ID NO: 31315 - RNA, 21 nt, Artificial Sequence
  Description of Artificial Sequence: Synthetic oligonucleotide
uuuaaaugacuaauuuuacuu

SEQ ID NO: 31316 - RNA, 21 nt, Artificial Sequence
  Description of Artificial Sequence: Synthetic oligonucleotide
uuuuaaaugacuaauuuuauu

SEQ ID NO: 31317 - RNA, 21 nt, Artificial Sequence
  Description of Artificial Sequence: Synthetic oligonucleotide
uauuuaaaugacuaauuuuuu

SEQ ID NO: 31318 - RNA, 21 nt, Artificial Sequence
  Description of Artificial Sequence: Synthetic oligonucleotide
uaauuuaaaugacuaauuuuu

SEQ ID NO: 31319 - RNA, 21 nt, Artificial Sequence
  Description of Artificial Sequence: Synthetic oligonucleotide
uuaauuuaaaugacuaauuuu

SEQ ID NO: 31320 - RNA, 21 nt, Artificial Sequence
  Description of Artificial Sequence: Synthetic oligonucleotide
uguaauuuaaaugacuaauuu

SEQ ID NO: 31321 - RNA, 21 nt, Artificial Sequence
  Description of Artificial Sequence: Synthetic oligonucleotide
uuguaauuuaaaugacuaauu

SEQ ID NO: 31322 - RNA, 21 nt, Artificial Sequence
  Description of Artificial Sequence: Synthetic oligonucleotide
uguguaauuuaaaugacuauu

SEQ ID NO: 31323 - RNA, 21 nt, Artificial Sequence
  Description of Artificial Sequence: Synthetic oligonucleotide
uaguguaauuuaaaugacuuu

SEQ ID NO: 31324 - RNA, 21 nt, Artificial Sequence
  Description of Artificial Sequence: Synthetic oligonucleotide
ucaguguaauuuaaaugacuu

SEQ ID NO: 31325 - RNA, 21 nt, Artificial Sequence
  Description of Artificial Sequence: Synthetic oligonucleotide
uacaguguaauuuaaaugauu

SEQ ID NO: 31326 - RNA, 21 nt, Artificial Sequence
  Description of Artificial Sequence: Synthetic oligonucleotide
ugacaguguaauuuaaauguu

SEQ ID NO: 31327 - RNA, 21 nt, Artificial Sequence
  Description of Artificial Sequence: Synthetic oligonucleotide
uugacaguguaauuuaaauuu

SEQ ID NO: 31328 - RNA, 21 nt, Artificial Sequence
  Description of Artificial Sequence: Synthetic oligonucleotide
uuugacaguguaauuuaaauu

SEQ ID NO: 31329 - RNA, 21 nt, Artificial Sequence
  Description of Artificial Sequence: Synthetic oligonucleotide
uauugacaguguaauuuaauu

SEQ ID NO: 31330 - RNA, 21 nt, Artificial Sequence
  Description of Artificial Sequence: Synthetic oligonucleotide
uaauugacaguguaauuuauu

SEQ ID NO: 31331 - RNA, 21 nt, Artificial Sequence
  Description of Artificial Sequence: Synthetic oligonucleotide
uuaauugacaguguaauuuuu

SEQ ID NO: 31332 - RNA, 21 nt, Artificial Sequence
  Description of Artificial Sequence: Synthetic oligonucleotide
uuuaauugacaguguaauuuu

SEQ ID NO: 31333 - RNA, 21 nt, Artificial Sequence
  Description of Artificial Sequence: Synthetic oligonucleotide
uuuuaauugacaguguaauuu

SEQ ID NO: 31334 - RNA, 21 nt, Artificial Sequence
  Description of Artificial Sequence: Synthetic oligonucleotide
uuuuuaauugacaguguaauu

SEQ ID NO: 31335 - RNA, 21 nt, Artificial Sequence
  Description of Artificial Sequence: Synthetic oligonucleotide
ucuuuuaauugacaguguauu

SEQ ID NO: 31336 - RNA, 21 nt, Artificial Sequence
  Description of Artificial Sequence: Synthetic oligonucleotide
uacuuuuaauugacaguguuu

SEQ ID NO: 31337 - RNA, 21 nt, Artificial Sequence
  Description of Artificial Sequence: Synthetic oligonucleotide
uuacuuuuaauugacaguguu

SEQ ID NO: 31338 - RNA, 21 nt, Artificial Sequence
  Description of Artificial Sequence: Synthetic oligonucleotide
uuuacuuuuaauugacaguuu

SEQ ID NO: 31339 - RNA, 21 nt, Artificial Sequence
  Description of Artificial Sequence: Synthetic oligonucleotide
uauuacuuuuaauugacaguu

SEQ ID NO: 31340 - RNA, 21 nt, Artificial Sequence
  Description of Artificial Sequence: Synthetic oligonucleotide
ucauuacuuuuaauugacauu

SEQ ID NO: 31341 - RNA, 21 nt, Artificial Sequence
  Description of Artificial Sequence: Synthetic oligonucleotide
uccauuacuuuuaauugacuu

SEQ ID NO: 31342 - RNA, 21 nt, Artificial Sequence
  Description of Artificial Sequence: Synthetic oligonucleotide
ucccauuacuuuuaauugauu

SEQ ID NO: 31343 - RNA, 21 nt, Artificial Sequence
  Description of Artificial Sequence: Synthetic oligonucleotide
ugcccauuacuuuuaauuguu

SEQ ID NO: 31344 - RNA, 21 nt, Artificial Sequence
  Description of Artificial Sequence: Synthetic oligonucleotide
uugcccauuacuuuuaauuuu

SEQ ID NO: 31345 - RNA, 21 nt, Artificial Sequence
  Description of Artificial Sequence: Synthetic oligonucleotide
uuugcccauuacuuuuaauuu

SEQ ID NO: 31346 - RNA, 21 nt, Artificial Sequence
  Description of Artificial Sequence: Synthetic oligonucleotide
ucuugcccauuacuuuuaauu

SEQ ID NO: 31347 - RNA, 21 nt, Artificial Sequence
  Description of Artificial Sequence: Synthetic oligonucleotide
uucuugcccauuacuuuuauu

SEQ ID NO: 31348 - RNA, 21 nt, Artificial Sequence
  Description of Artificial Sequence: Synthetic oligonucleotide
ucucuugcccauuacuuuuuu

SEQ ID NO: 31349 - RNA, 21 nt, Artificial Sequence
  Description of Artificial Sequence: Synthetic oligonucleotide
uucucuugcccauuacuuuuu

SEQ ID NO: 31350 - RNA, 21 nt, Artificial Sequence
  Description of Artificial Sequence: Synthetic oligonucleotide
uaucucuugcccauuacuuuu

SEQ ID NO: 31351 - RNA, 21 nt, Artificial Sequence
  Description of Artificial Sequence: Synthetic oligonucleotide
uaaucucuugcccauuacuuu

SEQ ID NO: 31352 - RNA, 21 nt, Artificial Sequence
  Description of Artificial Sequence: Synthetic oligonucleotide
ucaaucucuugcccauuacuu

SEQ ID NO: 31353 - RNA, 21 nt, Artificial Sequence
  Description of Artificial Sequence: Synthetic oligonucleotide
ugcaaucucuugcccauuauu

SEQ ID NO: 31354 - RNA, 21 nt, Artificial Sequence
  Description of Artificial Sequence: Synthetic oligonucleotide
uugcaaucucuugcccauuuu

SEQ ID NO: 31355 - RNA, 21 nt, Artificial Sequence
  Description of Artificial Sequence: Synthetic oligonucleotide
uaugcaaucucuugcccauuu

SEQ ID NO: 31356 - RNA, 21 nt, Artificial Sequence
  Description of Artificial Sequence: Synthetic oligonucleotide
ugaugcaaucucuugcccauu

SEQ ID NO: 31357 - RNA, 21 nt, Artificial Sequence
  Description of Artificial Sequence: Synthetic oligonucleotide
uugaugcaaucucuugcccuu

SEQ ID NO: 31358 - RNA, 21 nt, Artificial Sequence
  Description of Artificial Sequence: Synthetic oligonucleotide
uaugaugcaaucucuugccuu

SEQ ID NO: 31359 - RNA, 21 nt, Artificial Sequence
  Description of Artificial Sequence: Synthetic oligonucleotide
uuaugaugcaaucucuugcuu

SEQ ID NO: 31360 - RNA, 21 nt, Artificial Sequence
  Description of Artificial Sequence: Synthetic oligonucleotide
uguaugaugcaaucucuuguu

SEQ ID NO: 31361 - RNA, 21 nt, Artificial Sequence
  Description of Artificial Sequence: Synthetic oligonucleotide
uaguaugaugcaaucucuuuu

SEQ ID NO: 31362 - RNA, 21 nt, Artificial Sequence
  Description of Artificial Sequence: Synthetic oligonucleotide
uuaguaugaugcaaucucuuu

SEQ ID NO: 31363 - RNA, 21 nt, Artificial Sequence
  Description of Artificial Sequence: Synthetic oligonucleotide
uuuaguaugaugcaaucucuu

SEQ ID NO: 31364 - RNA, 21 nt, Artificial Sequence
  Description of Artificial Sequence: Synthetic oligonucleotide
uauuaguaugaugcaaucuuu

SEQ ID NO: 31365 - RNA, 21 nt, Artificial Sequence
  Description of Artificial Sequence: Synthetic oligonucleotide
uaauuaguaugaugcaaucuu

SEQ ID NO: 31366 - RNA, 21 nt, Artificial Sequence
  Description of Artificial Sequence: Synthetic oligonucleotide
uaaauuaguaugaugcaauuu

SEQ ID NO: 31367 - RNA, 21 nt, Artificial Sequence
  Description of Artificial Sequence: Synthetic oligonucleotide
uuaaauuaguaugaugcaauu

SEQ ID NO: 31368 - RNA, 21 nt, Artificial Sequence
  Description of Artificial Sequence: Synthetic oligonucleotide
ucuaaauuaguaugaugcauu

SEQ ID NO: 31369 - RNA, 21 nt, Artificial Sequence
  Description of Artificial Sequence: Synthetic oligonucleotide
uacuaaauuaguaugaugcuu

SEQ ID NO: 31370 - RNA, 21 nt, Artificial Sequence
  Description of Artificial Sequence: Synthetic oligonucleotide
uuacuaaauuaguaugauguu

SEQ ID NO: 31371 - RNA, 21 nt, Artificial Sequence
  Description of Artificial Sequence: Synthetic oligonucleotide
uuuacuaaauuaguaugauuu

SEQ ID NO: 31372 - RNA, 21 nt, Artificial Sequence
  Description of Artificial Sequence: Synthetic oligonucleotide
ucuuacuaaauuaguaugauu

SEQ ID NO: 31373 - RNA, 21 nt, Artificial Sequence
  Description of Artificial Sequence: Synthetic oligonucleotide
uucuuacuaaauuaguauguu

SEQ ID NO: 31374 - RNA, 21 nt, Artificial Sequence
  Description of Artificial Sequence: Synthetic oligonucleotide
uuucuuacuaaauuaguauuu

SEQ ID NO: 31375 - RNA, 21 nt, Artificial Sequence
  Description of Artificial Sequence: Synthetic oligonucleotide
uguucuuacuaaauuaguauu

SEQ ID NO: 31376 - RNA, 21 nt, Artificial Sequence
  Description of Artificial Sequence: Synthetic oligonucleotide
ucguucuuacuaaauuaguuu

SEQ ID NO: 31377 - RNA, 21 nt, Artificial Sequence
  Description of Artificial Sequence: Synthetic oligonucleotide
uacguucuuacuaaauuaguu

SEQ ID NO: 31378 - RNA, 21 nt, Artificial Sequence
  Description of Artificial Sequence: Synthetic oligonucleotide
uaacguucuuacuaaauuauu

SEQ ID NO: 31379 - RNA, 21 nt, Artificial Sequence
  Description of Artificial Sequence: Synthetic oligonucleotide
ugaacguucuuacuaaauuuu

SEQ ID NO: 31380 - RNA, 21 nt, Artificial Sequence
  Description of Artificial Sequence: Synthetic oligonucleotide
uggaacguucuuacuaaauuu

SEQ ID NO: 31381 - RNA, 21 nt, Artificial Sequence
  Description of Artificial Sequence: Synthetic oligonucleotide
ugggaacguucuuacuaaauu

SEQ ID NO: 31382 - RNA, 21 nt, Artificial Sequence
  Description of Artificial Sequence: Synthetic oligonucleotide
uugggaacguucuuacuaauu

SEQ ID NO: 31383 - RNA, 21 nt, Artificial Sequence
  Description of Artificial Sequence: Synthetic oligonucleotide
uuugggaacguucuuacuauu

SEQ ID NO: 31384 - RNA, 21 nt, Artificial Sequence
  Description of Artificial Sequence: Synthetic oligonucleotide
uuuugggaacguucuuacuuu

SEQ ID NO: 31385 - RNA, 21 nt, Artificial Sequence
  Description of Artificial Sequence: Synthetic oligonucleotide
uauuugggaacguucuuacuu

SEQ ID NO: 31386 - RNA, 21 nt, Artificial Sequence
  Description of Artificial Sequence: Synthetic oligonucleotide
ucauuugggaacguucuuauu

SEQ ID NO: 31387 - RNA, 21 nt, Artificial Sequence
  Description of Artificial Sequence: Synthetic oligonucleotide
uacauuugggaacguucuuuu

SEQ ID NO: 31388 - RNA, 21 nt, Artificial Sequence
  Description of Artificial Sequence: Synthetic oligonucleotide
uaacauuugggaacguucuuu

SEQ ID NO: 31389 - RNA, 21 nt, Artificial Sequence
  Description of Artificial Sequence: Synthetic oligonucleotide
ucaacauuugggaacguucuu

SEQ ID NO: 31390 - RNA, 21 nt, Artificial Sequence
  Description of Artificial Sequence: Synthetic oligonucleotide
uacaacauuugggaacguuuu

SEQ ID NO: 31391 - RNA, 21 nt, Artificial Sequence
  Description of Artificial Sequence: Synthetic oligonucleotide
uuacaacauuugggaacguuu

SEQ ID NO: 31392 - RNA, 21 nt, Artificial Sequence
  Description of Artificial Sequence: Synthetic oligonucleotide
uuuacaacauuugggaacguu

SEQ ID NO: 31393 - RNA, 21 nt, Artificial Sequence
  Description of Artificial Sequence: Synthetic oligonucleotide
uguuacaacauuugggaacuu

SEQ ID NO: 31394 - RNA, 21 nt, Artificial Sequence
  Description of Artificial Sequence: Synthetic oligonucleotide
uuguuacaacauuugggaauu

SEQ ID NO: 31395 - RNA, 21 nt, Artificial Sequence
  Description of Artificial Sequence: Synthetic oligonucleotide
uuuguuacaacauuugggauu

SEQ ID NO: 31396 - RNA, 21 nt, Artificial Sequence
  Description of Artificial Sequence: Synthetic oligonucleotide
uauuguuacaacauuuggguu

SEQ ID NO: 31397 - RNA, 21 nt, Artificial Sequence
  Description of Artificial Sequence: Synthetic oligonucleotide
ucauuguuacaacauuugguu

SEQ ID NO: 31398 - RNA, 21 nt, Artificial Sequence
  Description of Artificial Sequence: Synthetic oligonucleotide
uacauuguuacaacauuuguu

SEQ ID NO: 31399 - RNA, 21 nt, Artificial Sequence
  Description of Artificial Sequence: Synthetic oligonucleotide
ucacauuguuacaacauuuuu

SEQ ID NO: 31400 - RNA, 21 nt, Artificial Sequence
  Description of Artificial Sequence: Synthetic oligonucleotide
uccacauuguuacaacauuuu

SEQ ID NO: 31401 - RNA, 21 nt, Artificial Sequence
  Description of Artificial Sequence: Synthetic oligonucleotide
uuccacauuguuacaacauuu

SEQ ID NO: 31402 - RNA, 21 nt, Artificial Sequence
  Description of Artificial Sequence: Synthetic oligonucleotide
uauccacauuguuacaacauu

SEQ ID NO: 31403 - RNA, 21 nt, Artificial Sequence
  Description of Artificial Sequence: Synthetic oligonucleotide
ugauccacauuguuacaacuu

SEQ ID NO: 31404 - RNA, 21 nt, Artificial Sequence
  Description of Artificial Sequence: Synthetic oligonucleotide
uugauccacauuguuacaauu

SEQ ID NO: 31405 - RNA, 21 nt, Artificial Sequence
  Description of Artificial Sequence: Synthetic oligonucleotide
uaugauccacauuguuacauu

SEQ ID NO: 31406 - RNA, 21 nt, Artificial Sequence
  Description of Artificial Sequence: Synthetic oligonucleotide
uuaugauccacauuguuacuu

SEQ ID NO: 31407 - RNA, 21 nt, Artificial Sequence
  Description of Artificial Sequence: Synthetic oligonucleotide
uguaugauccacauuguuauu

SEQ ID NO: 31408 - RNA, 21 nt, Artificial Sequence
  Description of Artificial Sequence: Synthetic oligonucleotide
uuguaugauccacauuguuuu

SEQ ID NO: 31409 - RNA, 21 nt, Artificial Sequence
  Description of Artificial Sequence: Synthetic oligonucleotide
uauguaugauccacauuguuu

SEQ ID NO: 31410 - RNA, 21 nt, Artificial Sequence
  Description of Artificial Sequence: Synthetic oligonucleotide
ugauguaugauccacauuguu

SEQ ID NO: 31411 - RNA, 21 nt, Artificial Sequence
  Description of Artificial Sequence: Synthetic oligonucleotide
uagauguaugauccacauuuu

SEQ ID NO: 31412 - RNA, 21 nt, Artificial Sequence
  Description of Artificial Sequence: Synthetic oligonucleotide
ugagauguaugauccacauuu

SEQ ID NO: 31413 - RNA, 21 nt, Artificial Sequence
  Description of Artificial Sequence: Synthetic oligonucleotide
uagagauguaugauccacauu

SEQ ID NO: 31414 - RNA, 21 nt, Artificial Sequence
  Description of Artificial Sequence: Synthetic oligonucleotide
ucagagauguaugauccacuu

SEQ ID NO: 31415 - RNA, 21 nt, Artificial Sequence
  Description of Artificial Sequence: Synthetic oligonucleotide
uccagagauguaugauccauu

SEQ ID NO: 31416 - RNA, 21 nt, Artificial Sequence
  Description of Artificial Sequence: Synthetic oligonucleotide
uaccagagauguaugauccuu

SEQ ID NO: 31417 - RNA, 21 nt, Artificial Sequence
  Description of Artificial Sequence: Synthetic oligonucleotide
uaaccagagauguaugaucuu

SEQ ID NO: 31418 - RNA, 21 nt, Artificial Sequence
  Description of Artificial Sequence: Synthetic oligonucleotide
uaaaccagagauguaugauuu

SEQ ID NO: 31419 - RNA, 21 nt, Artificial Sequence
  Description of Artificial Sequence: Synthetic oligonucleotide
uaaaaccagagauguaugauu

SEQ ID NO: 31420 - RNA, 21 nt, Artificial Sequence
  Description of Artificial Sequence: Synthetic oligonucleotide
uaaaaaccagagauguauguu

SEQ ID NO: 31421 - RNA, 21 nt, Artificial Sequence
  Description of Artificial Sequence: Synthetic oligonucleotide
uaaaaaaccagagauguauuu

SEQ ID NO: 31422 - RNA, 21 nt, Artificial Sequence
  Description of Artificial Sequence: Synthetic oligonucleotide
uuaaaaaaccagagauguauu

SEQ ID NO: 31423 - RNA, 21 nt, Artificial Sequence
  Description of Artificial Sequence: Synthetic oligonucleotide
uuuaaaaaaccagagauguuu

SEQ ID NO: 31424 - RNA, 21 nt, Artificial Sequence
  Description of Artificial Sequence: Synthetic oligonucleotide
uuuuaaaaaaccagagauguu

SEQ ID NO: 31425 - RNA, 21 nt, Artificial Sequence
  Description of Artificial Sequence: Synthetic oligonucleotide
uauuuaaaaaaccagagauuu

SEQ ID NO: 31426 - RNA, 21 nt, Artificial Sequence
  Description of Artificial Sequence: Synthetic oligonucleotide
ucauuuaaaaaaccagagauu

SEQ ID NO: 31427 - RNA, 21 nt, Artificial Sequence
  Description of Artificial Sequence: Synthetic oligonucleotide
uacauuuaaaaaaccagaguu

SEQ ID NO: 31428 - RNA, 21 nt, Artificial Sequence
  Description of Artificial Sequence: Synthetic oligonucleotide
uuacauuuaaaaaaccagauu

SEQ ID NO: 31429 - RNA, 21 nt, Artificial Sequence
  Description of Artificial Sequence: Synthetic oligonucleotide
uauacauuuaaaaaaccaguu

SEQ ID NO: 31430 - RNA, 21 nt, Artificial Sequence
  Description of Artificial Sequence: Synthetic oligonucleotide
uaauacauuuaaaaaaccauu

SEQ ID NO: 31431 - RNA, 21 nt, Artificial Sequence
  Description of Artificial Sequence: Synthetic oligonucleotide
ucaauacauuuaaaaaaccuu

SEQ ID NO: 31432 - RNA, 21 nt, Artificial Sequence
  Description of Artificial Sequence: Synthetic oligonucleotide
uucaauacauuuaaaaaacuu

SEQ ID NO: 31433 - RNA, 21 nt, Artificial Sequence
  Description of Artificial Sequence: Synthetic oligonucleotide
ucucaauacauuuaaaaaauu

SEQ ID NO: 31434 - RNA, 21 nt, Artificial Sequence
  Description of Artificial Sequence: Synthetic oligonucleotide
uccucaauacauuuaaaaauu

SEQ ID NO: 31435 - RNA, 21 nt, Artificial Sequence
  Description of Artificial Sequence: Synthetic oligonucleotide
ugccucaauacauuuaaaauu

SEQ ID NO: 31436 - RNA, 21 nt, Artificial Sequence
  Description of Artificial Sequence: Synthetic oligonucleotide
uagccucaauacauuuaaauu

SEQ ID NO: 31437 - RNA, 21 nt, Artificial Sequence
  Description of Artificial Sequence: Synthetic oligonucleotide
uaagccucaauacauuuaauu

SEQ ID NO: 31438 - RNA, 21 nt, Artificial Sequence
  Description of Artificial Sequence: Synthetic oligonucleotide
uaaagccucaauacauuuauu

SEQ ID NO: 31439 - RNA, 21 nt, Artificial Sequence
  Description of Artificial Sequence: Synthetic oligonucleotide
ugaaagccucaauacauuuuu

SEQ ID NO: 31440 - RNA, 21 nt, Artificial Sequence
  Description of Artificial Sequence: Synthetic oligonucleotide
uagaaagccucaauacauuuu

SEQ ID NO: 31441 - RNA, 21 nt, Artificial Sequence
  Description of Artificial Sequence: Synthetic oligonucleotide
uaagaaagccucaauacauuu

SEQ ID NO: 31442 - RNA, 21 nt, Artificial Sequence
  Description of Artificial Sequence: Synthetic oligonucleotide
ucaagaaagccucaauacauu

SEQ ID NO: 31443 - RNA, 21 nt, Artificial Sequence
  Description of Artificial Sequence: Synthetic oligonucleotide
uccaagaaagccucaauacuu

SEQ ID NO: 31444 - RNA, 21 nt, Artificial Sequence
  Description of Artificial Sequence: Synthetic oligonucleotide
uaccaagaaagccucaauauu

SEQ ID NO: 31445 - RNA, 21 nt, Artificial Sequence
  Description of Artificial Sequence: Synthetic oligonucleotide
ucaccaagaaagccucaauuu

SEQ ID NO: 31446 - RNA, 21 nt, Artificial Sequence
  Description of Artificial Sequence: Synthetic oligonucleotide
uccaccaagaaagccucaauu

SEQ ID NO: 31447 - RNA, 21 nt, Artificial Sequence
  Description of Artificial Sequence: Synthetic oligonucleotide
uuccaccaagaaagccucauu

SEQ ID NO: 31448 - RNA, 21 nt, Artificial Sequence
  Description of Artificial Sequence: Synthetic oligonucleotide
uguccaccaagaaagccucuu

SEQ ID NO: 31449 - RNA, 21 nt, Artificial Sequence
  Description of Artificial Sequence: Synthetic oligonucleotide
uaguccaccaagaaagccuuu

SEQ ID NO: 31450 - RNA, 21 nt, Artificial Sequence
  Description of Artificial Sequence: Synthetic oligonucleotide
uuaguccaccaagaaagccuu

SEQ ID NO: 31451 - RNA, 21 nt, Artificial Sequence
  Description of Artificial Sequence: Synthetic oligonucleotide
ucuaguccaccaagaaagcuu

SEQ ID NO: 31452 - RNA, 21 nt, Artificial Sequence
  Description of Artificial Sequence: Synthetic oligonucleotide
uacuaguccaccaagaaaguu

SEQ ID NO: 31453 - RNA, 21 nt, Artificial Sequence
  Description of Artificial Sequence: Synthetic oligonucleotide
uuacuaguccaccaagaaauu

SEQ ID NO: 31454 - RNA, 21 nt, Artificial Sequence
  Description of Artificial Sequence: Synthetic oligonucleotide
uauacuaguccaccaagaauu

SEQ ID NO: 31455 - RNA, 21 nt, Artificial Sequence
  Description of Artificial Sequence: Synthetic oligonucleotide
uuauacuaguccaccaagauu

SEQ ID NO: 31456 - RNA, 21 nt, Artificial Sequence
  Description of Artificial Sequence: Synthetic oligonucleotide
ucuauacuaguccaccaaguu

SEQ ID NO: 31457 - RNA, 21 nt, Artificial Sequence
  Description of Artificial Sequence: Synthetic oligonucleotide
uacuauacuaguccaccaauu

SEQ ID NO: 31458 - RNA, 21 nt, Artificial Sequence
  Description of Artificial Sequence: Synthetic oligonucleotide
uuacuauacuaguccaccauu

SEQ ID NO: 31459 - RNA, 21 nt, Artificial Sequence
  Description of Artificial Sequence: Synthetic oligonucleotide
uauacuauacuaguccaccuu

SEQ ID NO: 31460 - RNA, 21 nt, Artificial Sequence
  Description of Artificial Sequence: Synthetic oligonucleotide
uuauacuauacuaguccacuu

SEQ ID NO: 31461 - RNA, 21 nt, Artificial Sequence
  Description of Artificial Sequence: Synthetic oligonucleotide
uguauacuauacuaguccauu

SEQ ID NO: 31462 - RNA, 21 nt, Artificial Sequence
  Description of Artificial Sequence: Synthetic oligonucleotide
ucguauacuauacuaguccuu

SEQ ID NO: 31463 - RNA, 21 nt, Artificial Sequence
  Description of Artificial Sequence: Synthetic oligonucleotide
uccguauacuauacuagucuu

SEQ ID NO: 31464 - RNA, 21 nt, Artificial Sequence
  Description of Artificial Sequence: Synthetic oligonucleotide
uaccguauacuauacuaguuu

SEQ ID NO: 31465 - RNA, 21 nt, Artificial Sequence
  Description of Artificial Sequence: Synthetic oligonucleotide
ugaccguauacuauacuaguu

SEQ ID NO: 31466 - RNA, 21 nt, Artificial Sequence
  Description of Artificial Sequence: Synthetic oligonucleotide
uugaccguauacuauacuauu

SEQ ID NO: 31467 - RNA, 21 nt, Artificial Sequence
  Description of Artificial Sequence: Synthetic oligonucleotide
ucugaccguauacuauacuuu

SEQ ID NO: 31468 - RNA, 21 nt, Artificial Sequence
  Description of Artificial Sequence: Synthetic oligonucleotide
uacugaccguauacuauacuu

SEQ ID NO: 31469 - RNA, 21 nt, Artificial Sequence
  Description of Artificial Sequence: Synthetic oligonucleotide
uaacugaccguauacuauauu

SEQ ID NO: 31470 - RNA, 21 nt, Artificial Sequence
  Description of Artificial Sequence: Synthetic oligonucleotide
uuaacugaccguauacuauuu

SEQ ID NO: 31471 - RNA, 21 nt, Artificial Sequence
  Description of Artificial Sequence: Synthetic oligonucleotide
uauaacugaccguauacuauu

SEQ ID NO: 31472 - RNA, 21 nt, Artificial Sequence
  Description of Artificial Sequence: Synthetic oligonucleotide
ucauaacugaccguauacuuu

SEQ ID NO: 31473 - RNA, 21 nt, Artificial Sequence
  Description of Artificial Sequence: Synthetic oligonucleotide
uacauaacugaccguauacuu

SEQ ID NO: 31474 - RNA, 21 nt, Artificial Sequence
  Description of Artificial Sequence: Synthetic oligonucleotide
ugacauaacugaccguauauu

SEQ ID NO: 31475 - RNA, 21 nt, Artificial Sequence
  Description of Artificial Sequence: Synthetic oligonucleotide
uugacauaacugaccguauuu

SEQ ID NO: 31476 - RNA, 21 nt, Artificial Sequence
  Description of Artificial Sequence: Synthetic oligonucleotide
uuugacauaacugaccguauu

SEQ ID NO: 31477 - RNA, 21 nt, Artificial Sequence
  Description of Artificial Sequence: Synthetic oligonucleotide
uauugacauaacugaccguuu

SEQ ID NO: 31478 - RNA, 21 nt, Artificial Sequence
  Description of Artificial Sequence: Synthetic oligonucleotide
ucauugacauaacugaccguu

SEQ ID NO: 31479 - RNA, 21 nt, Artificial Sequence
  Description of Artificial Sequence: Synthetic oligonucleotide
uacauugacauaacugaccuu

SEQ ID NO: 31480 - RNA, 21 nt, Artificial Sequence
  Description of Artificial Sequence: Synthetic oligonucleotide
uaacauugacauaacugacuu

SEQ ID NO: 31481 - RNA, 21 nt, Artificial Sequence
  Description of Artificial Sequence: Synthetic oligonucleotide
uaaacauugacauaacugauu

SEQ ID NO: 31482 - RNA, 21 nt, Artificial Sequence
  Description of Artificial Sequence: Synthetic oligonucleotide
ugaaacauugacauaacuguu

SEQ ID NO: 31483 - RNA, 21 nt, Artificial Sequence
  Description of Artificial Sequence: Synthetic oligonucleotide
uugaaacauugacauaacuuu

SEQ ID NO: 31484 - RNA, 21 nt, Artificial Sequence
  Description of Artificial Sequence: Synthetic oligonucleotide
uaugaaacauugacauaacuu

SEQ ID NO: 31485 - RNA, 21 nt, Artificial Sequence
  Description of Artificial Sequence: Synthetic oligonucleotide
ucaugaaacauugacauaauu

SEQ ID NO: 31486 - RNA, 21 nt, Artificial Sequence
  Description of Artificial Sequence: Synthetic oligonucleotide
uccaugaaacauugacauauu

SEQ ID NO: 31487 - RNA, 21 nt, Artificial Sequence
  Description of Artificial Sequence: Synthetic oligonucleotide
uaccaugaaacauugacauuu

SEQ ID NO: 31488 - RNA, 21 nt, Artificial Sequence
  Description of Artificial Sequence: Synthetic oligonucleotide
ugaccaugaaacauugacauu

SEQ ID NO: 31489 - RNA, 21 nt, Artificial Sequence
  Description of Artificial Sequence: Synthetic oligonucleotide
uugaccaugaaacauugacuu

SEQ ID NO: 31490 - RNA, 21 nt, Artificial Sequence
  Description of Artificial Sequence: Synthetic oligonucleotide
uuugaccaugaaacauugauu

SEQ ID NO: 31491 - RNA, 21 nt, Artificial Sequence
  Description of Artificial Sequence: Synthetic oligonucleotide
uauugaccaugaaacauuguu

SEQ ID NO: 31492 - RNA, 21 nt, Artificial Sequence
  Description of Artificial Sequence: Synthetic oligonucleotide
uuauugaccaugaaacauuuu

SEQ ID NO: 31493 - RNA, 21 nt, Artificial Sequence
  Description of Artificial Sequence: Synthetic oligonucleotide
uuuauugaccaugaaacauuu

SEQ ID NO: 31494 - RNA, 21 nt, Artificial Sequence
  Description of Artificial Sequence: Synthetic oligonucleotide
uuuuauugaccaugaaacauu

SEQ ID NO: 31495 - RNA, 21 nt, Artificial Sequence
  Description of Artificial Sequence: Synthetic oligonucleotide
uuuuuauugaccaugaaacuu

SEQ ID NO: 31496 - RNA, 21 nt, Artificial Sequence
  Description of Artificial Sequence: Synthetic oligonucleotide
uuuuuuauugaccaugaaauu

SEQ ID NO: 31497 - RNA, 21 nt, Artificial Sequence
  Description of Artificial Sequence: Synthetic oligonucleotide
ucuuuuuauugaccaugaauu

SEQ ID NO: 31498 - RNA, 21 nt, Artificial Sequence
  Description of Artificial Sequence: Synthetic oligonucleotide
uccuuuuuauugaccaugauu

SEQ ID NO: 31499 - RNA, 21 nt, Artificial Sequence
  Description of Artificial Sequence: Synthetic oligonucleotide
uuccuuuuuauugaccauguu

SEQ ID NO: 31500 - RNA, 21 nt, Artificial Sequence
  Description of Artificial Sequence: Synthetic oligonucleotide
uuuccuuuuuauugaccauuu

SEQ ID NO: 31501 - RNA, 21 nt, Artificial Sequence
  Description of Artificial Sequence: Synthetic oligonucleotide
ucuuccuuuuuauugaccauu

SEQ ID NO: 31502 - RNA, 21 nt, Artificial Sequence
  Description of Artificial Sequence: Synthetic oligonucleotide
uacuuccuuuuuauugaccuu

SEQ ID NO: 31503 - RNA, 21 nt, Artificial Sequence
  Description of Artificial Sequence: Synthetic oligonucleotide
uaacuuccuuuuuauugacuu

SEQ ID NO: 31504 - RNA, 21 nt, Artificial Sequence
  Description of Artificial Sequence: Synthetic oligonucleotide
ucaacuuccuuuuuauugauu

SEQ ID NO: 31505 - RNA, 21 nt, Artificial Sequence
  Description of Artificial Sequence: Synthetic oligonucleotide
ugcaacuuccuuuuuauuguu

SEQ ID NO: 31506 - RNA, 21 nt, Artificial Sequence
  Description of Artificial Sequence: Synthetic oligonucleotide
uugcaacuuccuuuuuauuuu

SEQ ID NO: 31507 - RNA, 21 nt, Artificial Sequence
  Description of Artificial Sequence: Synthetic oligonucleotide
uuugcaacuuccuuuuuauuu

SEQ ID NO: 31508 - RNA, 21 nt, Artificial Sequence
  Description of Artificial Sequence: Synthetic oligonucleotide
uuuugcaacuuccuuuuuauu

SEQ ID NO: 31509 - RNA, 21 nt, Artificial Sequence
  Description of Artificial Sequence: Synthetic oligonucleotide
uauuugcaacuuccuuuuuuu

SEQ ID NO: 31510 - RNA, 21 nt, Artificial Sequence
  Description of Artificial Sequence: Synthetic oligonucleotide
uaauuugcaacuuccuuuuuu

SEQ ID NO: 31511 - RNA, 21 nt, Artificial Sequence
  Description of Artificial Sequence: Synthetic oligonucleotide
ucaauuugcaacuuccuuuuu

SEQ ID NO: 31512 - RNA, 21 nt, Artificial Sequence
  Description of Artificial Sequence: Synthetic oligonucleotide
uacaauuugcaacuuccuuuu

SEQ ID NO: 31513 - RNA, 21 nt, Artificial Sequence
  Description of Artificial Sequence: Synthetic oligonucleotide
ucacaauuugcaacuuccuuu

SEQ ID NO: 31514 - RNA, 21 nt, Artificial Sequence
  Description of Artificial Sequence: Synthetic oligonucleotide
uaguuggagucucccugauuu

SEQ ID NO: 31515 - RNA, 21 nt, Artificial Sequence
  Description of Artificial Sequence: Synthetic oligonucleotide
uaaguuggagucucccugauu

SEQ ID NO: 31516 - RNA, 21 nt, Artificial Sequence
  Description of Artificial Sequence: Synthetic oligonucleotide
uuaaguuggagucucccuguu

SEQ ID NO: 31517 - RNA, 21 nt, Artificial Sequence
  Description of Artificial Sequence: Synthetic oligonucleotide
uuuaaguuggagucucccuuu

SEQ ID NO: 31518 - RNA, 21 nt, Artificial Sequence
  Description of Artificial Sequence: Synthetic oligonucleotide
ucuuaaguuggagucucccuu

SEQ ID NO: 31519 - RNA, 21 nt, Artificial Sequence
  Description of Artificial Sequence: Synthetic oligonucleotide
uccuuaaguuggagucuccuu

SEQ ID NO: 31520 - RNA, 21 nt, Artificial Sequence
  Description of Artificial Sequence: Synthetic oligonucleotide
ugccuuaaguuggagucucuu

SEQ ID NO: 31521 - RNA, 21 nt, Artificial Sequence
  Description of Artificial Sequence: Synthetic oligonucleotide
uugccuuaaguuggagucuuu

SEQ ID NO: 31522 - RNA, 21 nt, Artificial Sequence
  Description of Artificial Sequence: Synthetic oligonucleotide
uuugccuuaaguuggagucuu

SEQ ID NO: 31523 - RNA, 21 nt, Artificial Sequence
  Description of Artificial Sequence: Synthetic oligonucleotide
uguugccuuaaguuggaguuu

SEQ ID NO: 31524 - RNA, 21 nt, Artificial Sequence
  Description of Artificial Sequence: Synthetic oligonucleotide
uuguugccuuaaguuggaguu

SEQ ID NO: 31525 - RNA, 21 nt, Artificial Sequence
  Description of Artificial Sequence: Synthetic oligonucleotide
ucuguugccuuaaguuggauu

SEQ ID NO: 31526 - RNA, 21 nt, Artificial Sequence
  Description of Artificial Sequence: Synthetic oligonucleotide
ugcuguugccuuaaguugguu

SEQ ID NO: 31527 - RNA, 21 nt, Artificial Sequence
  Description of Artificial Sequence: Synthetic oligonucleotide
uugcuguugccuuaaguuguu

SEQ ID NO: 31528 - RNA, 21 nt, Artificial Sequence
  Description of Artificial Sequence: Synthetic oligonucleotide
uaugcuguugccuuaaguuuu

SEQ ID NO: 31529 - RNA, 21 nt, Artificial Sequence
  Description of Artificial Sequence: Synthetic oligonucleotide
ucaugcuguugccuuaaguuu

SEQ ID NO: 31530 - RNA, 21 nt, Artificial Sequence
  Description of Artificial Sequence: Synthetic oligonucleotide
uccaugcuguugccuuaaguu

SEQ ID NO: 31531 - RNA, 21 nt, Artificial Sequence
  Description of Artificial Sequence: Synthetic oligonucleotide
ucccaugcuguugccuuaauu

SEQ ID NO: 31532 - RNA, 21 nt, Artificial Sequence
  Description of Artificial Sequence: Synthetic oligonucleotide
uacccaugcuguugccuuauu

SEQ ID NO: 31533 - RNA, 21 nt, Artificial Sequence
  Description of Artificial Sequence: Synthetic oligonucleotide
ucacccaugcuguugccuuuu

SEQ ID NO: 31534 - RNA, 21 nt, Artificial Sequence
  Description of Artificial Sequence: Synthetic oligonucleotide
uucacccaugcuguugccuuu

SEQ ID NO: 31535 - RNA, 21 nt, Artificial Sequence
  Description of Artificial Sequence: Synthetic oligonucleotide
uuucacccaugcuguugccuu

SEQ ID NO: 31536 - RNA, 21 nt, Artificial Sequence
  Description of Artificial Sequence: Synthetic oligonucleotide
uauucacccaugcuguugcuu

SEQ ID NO: 31537 - RNA, 21 nt, Artificial Sequence
  Description of Artificial Sequence: Synthetic oligonucleotide
uuauucacccaugcuguuguu

SEQ ID NO: 31538 - RNA, 21 nt, Artificial Sequence
  Description of Artificial Sequence: Synthetic oligonucleotide
uuuauucacccaugcuguuuu

SEQ ID NO: 31539 - RNA, 21 nt, Artificial Sequence
  Description of Artificial Sequence: Synthetic oligonucleotide
ucuuauucacccaugcuguuu

SEQ ID NO: 31540 - RNA, 21 nt, Artificial Sequence
  Description of Artificial Sequence: Synthetic oligonucleotide
uccuuauucacccaugcuguu

SEQ ID NO: 31541 - RNA, 21 nt, Artificial Sequence
  Description of Artificial Sequence: Synthetic oligonucleotide
ucccuuauucacccaugcuuu

SEQ ID NO: 31542 - RNA, 21 nt, Artificial Sequence
  Description of Artificial Sequence: Synthetic oligonucleotide
ugcccuuauucacccaugcuu

SEQ ID NO: 31543 - RNA, 21 nt, Artificial Sequence
  Description of Artificial Sequence: Synthetic oligonucleotide
uagcccuuauucacccauguu

SEQ ID NO: 31544 - RNA, 21 nt, Artificial Sequence
  Description of Artificial Sequence: Synthetic oligonucleotide
uaagcccuuauucacccauuu

SEQ ID NO: 31545 - RNA, 21 nt, Artificial Sequence
  Description of Artificial Sequence: Synthetic oligonucleotide
ugaagcccuuauucacccauu

SEQ ID NO: 31546 - RNA, 21 nt, Artificial Sequence
  Description of Artificial Sequence: Synthetic oligonucleotide
uggaagcccuuauucacccuu

SEQ ID NO: 31547 - RNA, 21 nt, Artificial Sequence
  Description of Artificial Sequence: Synthetic oligonucleotide
uaggaagcccuuauucaccuu

SEQ ID NO: 31548 - RNA, 21 nt, Artificial Sequence
  Description of Artificial Sequence: Synthetic oligonucleotide
ucaggaagcccuuauucacuu

SEQ ID NO: 31549 - RNA, 21 nt, Artificial Sequence
  Description of Artificial Sequence: Synthetic oligonucleotide
uacaggaagcccuuauucauu

SEQ ID NO: 31550 - RNA, 21 nt, Artificial Sequence
  Description of Artificial Sequence: Synthetic oligonucleotide
ucacaggaagcccuuauucuu

SEQ ID NO: 31551 - RNA, 21 nt, Artificial Sequence
  Description of Artificial Sequence: Synthetic oligonucleotide
uccacaggaagcccuuauuuu

SEQ ID NO: 31552 - RNA, 21 nt, Artificial Sequence
  Description of Artificial Sequence: Synthetic oligonucleotide
uuccacaggaagcccuuauuu

SEQ ID NO: 31553 - RNA, 21 nt, Artificial Sequence
  Description of Artificial Sequence: Synthetic oligonucleotide
uguccacaggaagcccuuauu

SEQ ID NO: 31554 - RNA, 21 nt, Artificial Sequence
  Description of Artificial Sequence: Synthetic oligonucleotide
uaguccacaggaagcccuuuu

SEQ ID NO: 31555 - RNA, 21 nt, Artificial Sequence
  Description of Artificial Sequence: Synthetic oligonucleotide
ucaguccacaggaagcccuuu

SEQ ID NO: 31556 - RNA, 21 nt, Artificial Sequence
  Description of Artificial Sequence: Synthetic oligonucleotide
uccaguccacaggaagcccuu

SEQ ID NO: 31557 - RNA, 21 nt, Artificial Sequence
  Description of Artificial Sequence: Synthetic oligonucleotide
ugccaguccacaggaagccuu

SEQ ID NO: 31558 - RNA, 21 nt, Artificial Sequence
  Description of Artificial Sequence: Synthetic oligonucleotide
uugccaguccacaggaagcuu

SEQ ID NO: 31559 - RNA, 21 nt, Artificial Sequence
  Description of Artificial Sequence: Synthetic oligonucleotide
uuugccaguccacaggaaguu

SEQ ID NO: 31560 - RNA, 21 nt, Artificial Sequence
  Description of Artificial Sequence: Synthetic oligonucleotide
uauugccaguccacaggaauu

SEQ ID NO: 31561 - RNA, 21 nt, Artificial Sequence
  Description of Artificial Sequence: Synthetic oligonucleotide
ucauugccaguccacaggauu

SEQ ID NO: 31562 - RNA, 21 nt, Artificial Sequence
  Description of Artificial Sequence: Synthetic oligonucleotide
uucauugccaguccacagguu

SEQ ID NO: 31563 - RNA, 21 nt, Artificial Sequence
  Description of Artificial Sequence: Synthetic oligonucleotide
ucucauugccaguccacaguu

SEQ ID NO: 31564 - RNA, 21 nt, Artificial Sequence
  Description of Artificial Sequence: Synthetic oligonucleotide
uucucauugccaguccacauu

SEQ ID NO: 31565 - RNA, 21 nt, Artificial Sequence
  Description of Artificial Sequence: Synthetic oligonucleotide
ucucucauugccaguccacuu

SEQ ID NO: 31566 - RNA, 21 nt, Artificial Sequence
  Description of Artificial Sequence: Synthetic oligonucleotide
uccucucauugccaguccauu

SEQ ID NO: 31567 - RNA, 21 nt, Artificial Sequence
  Description of Artificial Sequence: Synthetic oligonucleotide
ugccucucauugccaguccuu

SEQ ID NO: 31568 - RNA, 21 nt, Artificial Sequence
  Description of Artificial Sequence: Synthetic oligonucleotide
uugccucucauugccagucuu

SEQ ID NO: 31569 - RNA, 21 nt, Artificial Sequence
  Description of Artificial Sequence: Synthetic oligonucleotide
uuugccucucauugccaguuu

SEQ ID NO: 31570 - RNA, 21 nt, Artificial Sequence
  Description of Artificial Sequence: Synthetic oligonucleotide
uuuugccucucauugccaguu

SEQ ID NO: 31571 - RNA, 21 nt, Artificial Sequence
  Description of Artificial Sequence: Synthetic oligonucleotide
uuuuugccucucauugccauu

SEQ ID NO: 31572 - RNA, 21 nt, Artificial Sequence
  Description of Artificial Sequence: Synthetic oligonucleotide
uguuuugccucucauugccuu

SEQ ID NO: 31573 - RNA, 21 nt, Artificial Sequence
  Description of Artificial Sequence: Synthetic oligonucleotide
ugguuuugccucucauugcuu

SEQ ID NO: 31574 - RNA, 21 nt, Artificial Sequence
  Description of Artificial Sequence: Synthetic oligonucleotide
uagguuuugccucucauuguu

SEQ ID NO: 31575 - RNA, 21 nt, Artificial Sequence
  Description of Artificial Sequence: Synthetic oligonucleotide
ucagguuuugccucucauuuu

SEQ ID NO: 31576 - RNA, 21 nt, Artificial Sequence
  Description of Artificial Sequence: Synthetic oligonucleotide
uccagguuuugccucucauuu

SEQ ID NO: 31577 - RNA, 21 nt, Artificial Sequence
  Description of Artificial Sequence: Synthetic oligonucleotide
uaccagguuuugccucucauu

SEQ ID NO: 31578 - RNA, 21 nt, Artificial Sequence
  Description of Artificial Sequence: Synthetic oligonucleotide
ucaccagguuuugccucucuu

SEQ ID NO: 31579 - RNA, 21 nt, Artificial Sequence
  Description of Artificial Sequence: Synthetic oligonucleotide
ugcaccagguuuugccucuuu

SEQ ID NO: 31580 - RNA, 21 nt, Artificial Sequence
  Description of Artificial Sequence: Synthetic oligonucleotide
uagcaccagguuuugccucuu

SEQ ID NO: 31581 - RNA, 21 nt, Artificial Sequence
  Description of Artificial Sequence: Synthetic oligonucleotide
uaagcaccagguuuugccuuu

SEQ ID NO: 31582 - RNA, 21 nt, Artificial Sequence
  Description of Artificial Sequence: Synthetic oligonucleotide
ucaagcaccagguuuugccuu

SEQ ID NO: 31583 - RNA, 21 nt, Artificial Sequence
  Description of Artificial Sequence: Synthetic oligonucleotide
uucaagcaccagguuuugcuu

SEQ ID NO: 31584 - RNA, 21 nt, Artificial Sequence
  Description of Artificial Sequence: Synthetic oligonucleotide
ucucaagcaccagguuuuguu

SEQ ID NO: 31585 - RNA, 21 nt, Artificial Sequence
  Description of Artificial Sequence: Synthetic oligonucleotide
ugcucaagcaccagguuuuuu

SEQ ID NO: 31586 - RNA, 21 nt, Artificial Sequence
  Description of Artificial Sequence: Synthetic oligonucleotide
uugcucaagcaccagguuuuu

SEQ ID NO: 31587 - RNA, 21 nt, Artificial Sequence
  Description of Artificial Sequence: Synthetic oligonucleotide
ugugcucaagcaccagguuuu

SEQ ID NO: 31588 - RNA, 21 nt, Artificial Sequence
  Description of Artificial Sequence: Synthetic oligonucleotide
uagugcucaagcaccagguuu

SEQ ID NO: 31589 - RNA, 21 nt, Artificial Sequence
  Description of Artificial Sequence: Synthetic oligonucleotide
ucagugcucaagcaccagguu

SEQ ID NO: 31590 - RNA, 21 nt, Artificial Sequence
  Description of Artificial Sequence: Synthetic oligonucleotide
uccagugcucaagcaccaguu

SEQ ID NO: 31591 - RNA, 21 nt, Artificial Sequence
  Description of Artificial Sequence: Synthetic oligonucleotide
ugccagugcucaagcaccauu

SEQ ID NO: 31592 - RNA, 21 nt, Artificial Sequence
  Description of Artificial Sequence: Synthetic oligonucleotide
uggccagugcucaagcaccuu

SEQ ID NO: 31593 - RNA, 21 nt, Artificial Sequence
  Description of Artificial Sequence: Synthetic oligonucleotide
ugggccagugcucaagcacuu

SEQ ID NO: 31594 - RNA, 21 nt, Artificial Sequence
  Description of Artificial Sequence: Synthetic oligonucleotide
uggggccagugcucaagcauu

SEQ ID NO: 31595 - RNA, 21 nt, Artificial Sequence
  Description of Artificial Sequence: Synthetic oligonucleotide
uaggggccagugcucaagcuu

SEQ ID NO: 31596 - RNA, 21 nt, Artificial Sequence
  Description of Artificial Sequence: Synthetic oligonucleotide
uuaggggccagugcucaaguu

SEQ ID NO: 31597 - RNA, 21 nt, Artificial Sequence
  Description of Artificial Sequence: Synthetic oligonucleotide
uuuaggggccagugcucaauu

SEQ ID NO: 31598 - RNA, 21 nt, Artificial Sequence
  Description of Artificial Sequence: Synthetic oligonucleotide
ucuuaggggccagugcucauu

SEQ ID NO: 31599 - RNA, 21 nt, Artificial Sequence
  Description of Artificial Sequence: Synthetic oligonucleotide
uccuuaggggccagugcucuu

SEQ ID NO: 31600 - RNA, 21 nt, Artificial Sequence
  Description of Artificial Sequence: Synthetic oligonucleotide
ugccuuaggggccagugcuuu

SEQ ID NO: 31601 - RNA, 21 nt, Artificial Sequence
  Description of Artificial Sequence: Synthetic oligonucleotide
uugccuuaggggccagugcuu

SEQ ID NO: 31602 - RNA, 21 nt, Artificial Sequence
  Description of Artificial Sequence: Synthetic oligonucleotide
ucugccuuaggggccaguguu

SEQ ID NO: 31603 - RNA, 21 nt, Artificial Sequence
  Description of Artificial Sequence: Synthetic oligonucleotide
uccugccuuaggggccaguuu

SEQ ID NO: 31604 - RNA, 21 nt, Artificial Sequence
  Description of Artificial Sequence: Synthetic oligonucleotide
ugccugccuuaggggccaguu

SEQ ID NO: 31605 - RNA, 21 nt, Artificial Sequence
  Description of Artificial Sequence: Synthetic oligonucleotide
uggccugccuuaggggccauu

SEQ ID NO: 31606 - RNA, 21 nt, Artificial Sequence
  Description of Artificial Sequence: Synthetic oligonucleotide
uaggccugccuuaggggccuu

SEQ ID NO: 31607 - RNA, 21 nt, Artificial Sequence
  Description of Artificial Sequence: Synthetic oligonucleotide
uaaggccugccuuaggggcuu

SEQ ID NO: 31608 - RNA, 21 nt, Artificial Sequence
  Description of Artificial Sequence: Synthetic oligonucleotide
uuaaggccugccuuagggguu

SEQ ID NO: 31609 - RNA, 21 nt, Artificial Sequence
  Description of Artificial Sequence: Synthetic oligonucleotide
uguaaggccugccuuaggguu

SEQ ID NO: 31610 - RNA, 21 nt, Artificial Sequence
  Description of Artificial Sequence: Synthetic oligonucleotide
uuguaaggccugccuuagguu

SEQ ID NO: 31611 - RNA, 21 nt, Artificial Sequence
  Description of Artificial Sequence: Synthetic oligonucleotide
ucuguaaggccugccuuaguu

SEQ ID NO: 31612 - RNA, 21 nt, Artificial Sequence
  Description of Artificial Sequence: Synthetic oligonucleotide
uucuguaaggccugccuuauu

SEQ ID NO: 31613 - RNA, 21 nt, Artificial Sequence
  Description of Artificial Sequence: Synthetic oligonucleotide
uaucuguaaggccugccuuuu

SEQ ID NO: 31614 - RNA, 21 nt, Artificial Sequence
  Description of Artificial Sequence: Synthetic oligonucleotide
ugaucuguaaggccugccuuu

SEQ ID NO: 31615 - RNA, 21 nt, Artificial Sequence
  Description of Artificial Sequence: Synthetic oligonucleotide
uagaucuguaaggccugccuu

SEQ ID NO: 31616 - RNA, 21 nt, Artificial Sequence
  Description of Artificial Sequence: Synthetic oligonucleotide
ugagaucuguaaggccugcuu

SEQ ID NO: 31617 - RNA, 21 nt, Artificial Sequence
  Description of Artificial Sequence: Synthetic oligonucleotide
uagagaucuguaaggccuguu

SEQ ID NO: 31618 - RNA, 21 nt, Artificial Sequence
  Description of Artificial Sequence: Synthetic oligonucleotide
uaagagaucuguaaggccuuu

SEQ ID NO: 31619 - RNA, 21 nt, Artificial Sequence
  Description of Artificial Sequence: Synthetic oligonucleotide
uuaagagaucuguaaggccuu

SEQ ID NO: 31620 - RNA, 21 nt, Artificial Sequence
  Description of Artificial Sequence: Synthetic oligonucleotide
uguaagagaucuguaaggcuu

SEQ ID NO: 31621 - RNA, 21 nt, Artificial Sequence
  Description of Artificial Sequence: Synthetic oligonucleotide
uuguaagagaucuguaagguu

SEQ ID NO: 31622 - RNA, 21 nt, Artificial Sequence
  Description of Artificial Sequence: Synthetic oligonucleotide
uguguaagagaucuguaaguu

SEQ ID NO: 31623 - RNA, 21 nt, Artificial Sequence
  Description of Artificial Sequence: Synthetic oligonucleotide
uaguguaagagaucuguaauu

SEQ ID NO: 31624 - RNA, 21 nt, Artificial Sequence
  Description of Artificial Sequence: Synthetic oligonucleotide
ugaguguaagagaucuguauu

SEQ ID NO: 31625 - RNA, 21 nt, Artificial Sequence
  Description of Artificial Sequence: Synthetic oligonucleotide
ucgaguguaagagaucuguuu

SEQ ID NO: 31626 - RNA, 21 nt, Artificial Sequence
  Description of Artificial Sequence: Synthetic oligonucleotide
uacgaguguaagagaucuguu

SEQ ID NO: 31627 - RNA, 21 nt, Artificial Sequence
  Description of Artificial Sequence: Synthetic oligonucleotide
ucacgaguguaagagaucuuu

SEQ ID NO: 31628 - RNA, 21 nt, Artificial Sequence
  Description of Artificial Sequence: Synthetic oligonucleotide
uccacgaguguaagagaucuu

SEQ ID NO: 31629 - RNA, 21 nt, Artificial Sequence
  Description of Artificial Sequence: Synthetic oligonucleotide
uaccacgaguguaagagauuu

SEQ ID NO: 31630 - RNA, 21 nt, Artificial Sequence
  Description of Artificial Sequence: Synthetic oligonucleotide
ucaccacgaguguaagagauu

SEQ ID NO: 31631 - RNA, 21 nt, Artificial Sequence
  Description of Artificial Sequence: Synthetic oligonucleotide
uccaccacgaguguaagaguu

SEQ ID NO: 31632 - RNA, 21 nt, Artificial Sequence
  Description of Artificial Sequence: Synthetic oligonucleotide
ucccaccacgaguguaagauu

SEQ ID NO: 31633 - RNA, 21 nt, Artificial Sequence
  Description of Artificial Sequence: Synthetic oligonucleotide
uucccaccacgaguguaaguu

SEQ ID NO: 31634 - RNA, 21 nt, Artificial Sequence
  Description of Artificial Sequence: Synthetic oligonucleotide
uuucccaccacgaguguaauu

SEQ ID NO: 31635 - RNA, 21 nt, Artificial Sequence
  Description of Artificial Sequence: Synthetic oligonucleotide
ucuucccaccacgaguguauu

SEQ ID NO: 31636 - RNA, 21 nt, Artificial Sequence
  Description of Artificial Sequence: Synthetic oligonucleotide
uucuucccaccacgaguguuu

SEQ ID NO: 31637 - RNA, 21 nt, Artificial Sequence
  Description of Artificial Sequence: Synthetic oligonucleotide
ucucuucccaccacgaguguu

SEQ ID NO: 31638 - RNA, 21 nt, Artificial Sequence
  Description of Artificial Sequence: Synthetic oligonucleotide
uacucuucccaccacgaguuu

SEQ ID NO: 31639 - RNA, 21 nt, Artificial Sequence
  Description of Artificial Sequence: Synthetic oligonucleotide
uaacucuucccaccacgaguu

SEQ ID NO: 31640 - RNA, 21 nt, Artificial Sequence
  Description of Artificial Sequence: Synthetic oligonucleotide
uaaacucuucccaccacgauu

SEQ ID NO: 31641 - RNA, 21 nt, Artificial Sequence
  Description of Artificial Sequence: Synthetic oligonucleotide
uuaaacucuucccaccacguu

SEQ ID NO: 31642 - RNA, 21 nt, Artificial Sequence
  Description of Artificial Sequence: Synthetic oligonucleotide
ucuaaacucuucccaccacuu

SEQ ID NO: 31643 - RNA, 21 nt, Artificial Sequence
  Description of Artificial Sequence: Synthetic oligonucleotide
uacuaaacucuucccaccauu

SEQ ID NO: 31644 - RNA, 21 nt, Artificial Sequence
  Description of Artificial Sequence: Synthetic oligonucleotide
ucacuaaacucuucccaccuu

SEQ ID NO: 31645 - RNA, 21 nt, Artificial Sequence
  Description of Artificial Sequence: Synthetic oligonucleotide
uacacuaaacucuucccacuu

SEQ ID NO: 31646 - RNA, 21 nt, Artificial Sequence
  Description of Artificial Sequence: Synthetic oligonucleotide
ucacacuaaacucuucccauu

SEQ ID NO: 31647 - RNA, 21 nt, Artificial Sequence
  Description of Artificial Sequence: Synthetic oligonucleotide
uucacacuaaacucuucccuu

SEQ ID NO: 31648 - RNA, 21 nt, Artificial Sequence
  Description of Artificial Sequence: Synthetic oligonucleotide
uuucacacuaaacucuuccuu

SEQ ID NO: 31649 - RNA, 21 nt, Artificial Sequence
  Description of Artificial Sequence: Synthetic oligonucleotide
uuuucacacuaaacucuucuu

SEQ ID NO: 31650 - RNA, 21 nt, Artificial Sequence
  Description of Artificial Sequence: Synthetic oligonucleotide
uguuucacacuaaacucuuuu

SEQ ID NO: 31651 - RNA, 21 nt, Artificial Sequence
  Description of Artificial Sequence: Synthetic oligonucleotide
uaguuucacacuaaacucuuu

SEQ ID NO: 31652 - RNA, 21 nt, Artificial Sequence
  Description of Artificial Sequence: Synthetic oligonucleotide
ucaguuucacacuaaacucuu

SEQ ID NO: 31653 - RNA, 21 nt, Artificial Sequence
  Description of Artificial Sequence: Synthetic oligonucleotide
uccaguuucacacuaaacuuu

SEQ ID NO: 31654 - RNA, 21 nt, Artificial Sequence
  Description of Artificial Sequence: Synthetic oligonucleotide
ucccaguuucacacuaaacuu

SEQ ID NO: 31655 - RNA, 21 nt, Artificial Sequence
  Description of Artificial Sequence: Synthetic oligonucleotide
uccccaguuucacacuaaauu

SEQ ID NO: 31656 - RNA, 21 nt, Artificial Sequence
  Description of Artificial Sequence: Synthetic oligonucleotide
uaccccaguuucacacuaauu

SEQ ID NO: 31657 - RNA, 21 nt, Artificial Sequence
  Description of Artificial Sequence: Synthetic oligonucleotide
ucaccccaguuucacacuauu

SEQ ID NO: 31658 - RNA, 21 nt, Artificial Sequence
  Description of Artificial Sequence: Synthetic oligonucleotide
uccaccccaguuucacacuuu

SEQ ID NO: 31659 - RNA, 21 nt, Artificial Sequence
  Description of Artificial Sequence: Synthetic oligonucleotide
uuccaccccaguuucacacuu

SEQ ID NO: 31660 - RNA, 21 nt, Artificial Sequence
  Description of Artificial Sequence: Synthetic oligonucleotide
uuuccaccccaguuucacauu

SEQ ID NO: 31661 - RNA, 21 nt, Artificial Sequence
  Description of Artificial Sequence: Synthetic oligonucleotide
uauuccaccccaguuucacuu

SEQ ID NO: 31662 - RNA, 21 nt, Artificial Sequence
  Description of Artificial Sequence: Synthetic oligonucleotide
uaauuccaccccaguuucauu

SEQ ID NO: 31663 - RNA, 21 nt, Artificial Sequence
  Description of Artificial Sequence: Synthetic oligonucleotide
ucaauuccaccccaguuucuu

SEQ ID NO: 31664 - RNA, 21 nt, Artificial Sequence
  Description of Artificial Sequence: Synthetic oligonucleotide
uccaauuccaccccaguuuuu

SEQ ID NO: 31665 - RNA, 21 nt, Artificial Sequence
  Description of Artificial Sequence: Synthetic oligonucleotide
ucccaauuccaccccaguuuu

SEQ ID NO: 31666 - RNA, 21 nt, Artificial Sequence
  Description of Artificial Sequence: Synthetic oligonucleotide
uacccaauuccaccccaguuu

SEQ ID NO: 31667 - RNA, 21 nt, Artificial Sequence
  Description of Artificial Sequence: Synthetic oligonucleotide
ucacccaauuccaccccaguu

SEQ ID NO: 31668 - RNA, 21 nt, Artificial Sequence
  Description of Artificial Sequence: Synthetic oligonucleotide
uacacccaauuccaccccauu

SEQ ID NO: 31669 - RNA, 21 nt, Artificial Sequence
  Description of Artificial Sequence: Synthetic oligonucleotide
ugacacccaauuccaccccuu

SEQ ID NO: 31670 - RNA, 21 nt, Artificial Sequence
  Description of Artificial Sequence: Synthetic oligonucleotide
uggacacccaauuccacccuu

SEQ ID NO: 31671 - RNA, 21 nt, Artificial Sequence
  Description of Artificial Sequence: Synthetic oligonucleotide
uuggacacccaauuccaccuu

SEQ ID NO: 31672 - RNA, 21 nt, Artificial Sequence
  Description of Artificial Sequence: Synthetic oligonucleotide
uguggacacccaauuccacuu

SEQ ID NO: 31673 - RNA, 21 nt, Artificial Sequence
  Description of Artificial Sequence: Synthetic oligonucleotide
ucguggacacccaauuccauu

SEQ ID NO: 31674 - RNA, 21 nt, Artificial Sequence
  Description of Artificial Sequence: Synthetic oligonucleotide
uacguggacacccaauuccuu

SEQ ID NO: 31675 - RNA, 21 nt, Artificial Sequence
  Description of Artificial Sequence: Synthetic oligonucleotide
uuacguggacacccaauucuu

SEQ ID NO: 31676 - RNA, 21 nt, Artificial Sequence
  Description of Artificial Sequence: Synthetic oligonucleotide
uauacguggacacccaauuuu

SEQ ID NO: 31677 - RNA, 21 nt, Artificial Sequence
  Description of Artificial Sequence: Synthetic oligonucleotide
ucauacguggacacccaauuu

SEQ ID NO: 31678 - RNA, 21 nt, Artificial Sequence
  Description of Artificial Sequence: Synthetic oligonucleotide
uacauacguggacacccaauu

SEQ ID NO: 31679 - RNA, 21 nt, Artificial Sequence
  Description of Artificial Sequence: Synthetic oligonucleotide
uaacauacguggacacccauu

SEQ ID NO: 31680 - RNA, 21 nt, Artificial Sequence
  Description of Artificial Sequence: Synthetic oligonucleotide
ugaacauacguggacacccuu

SEQ ID NO: 31681 - RNA, 21 nt, Artificial Sequence
  Description of Artificial Sequence: Synthetic oligonucleotide
uggaacauacguggacaccuu

SEQ ID NO: 31682 - RNA, 21 nt, Artificial Sequence
  Description of Artificial Sequence: Synthetic oligonucleotide
ugggaacauacguggacacuu

SEQ ID NO: 31683 - RNA, 21 nt, Artificial Sequence
  Description of Artificial Sequence: Synthetic oligonucleotide
uagggaacauacguggacauu

SEQ ID NO: 31684 - RNA, 21 nt, Artificial Sequence
  Description of Artificial Sequence: Synthetic oligonucleotide
uaagggaacauacguggacuu

SEQ ID NO: 31685 - RNA, 21 nt, Artificial Sequence
  Description of Artificial Sequence: Synthetic oligonucleotide
uaaagggaacauacguggauu

SEQ ID NO: 31686 - RNA, 21 nt, Artificial Sequence
  Description of Artificial Sequence: Synthetic oligonucleotide
uaaaagggaacauacgugguu

SEQ ID NO: 31687 - RNA, 21 nt, Artificial Sequence
  Description of Artificial Sequence: Synthetic oligonucleotide
ucaaaagggaacauacguguu

SEQ ID NO: 31688 - RNA, 21 nt, Artificial Sequence
  Description of Artificial Sequence: Synthetic oligonucleotide
ugcaaaagggaacauacguuu

SEQ ID NO: 31689 - RNA, 21 nt, Artificial Sequence
  Description of Artificial Sequence: Synthetic oligonucleotide
uggcaaaagggaacauacguu

SEQ ID NO: 31690 - RNA, 21 nt, Artificial Sequence
  Description of Artificial Sequence: Synthetic oligonucleotide
uaggcaaaagggaacauacuu

SEQ ID NO: 31691 - RNA, 21 nt, Artificial Sequence
  Description of Artificial Sequence: Synthetic oligonucleotide
uaaggcaaaagggaacauauu

SEQ ID NO: 31692 - RNA, 21 nt, Artificial Sequence
  Description of Artificial Sequence: Synthetic oligonucleotide
uuaaggcaaaagggaacauuu

SEQ ID NO: 31693 - RNA, 21 nt, Artificial Sequence
  Description of Artificial Sequence: Synthetic oligonucleotide
uguaaggcaaaagggaacauu

SEQ ID NO: 31694 - RNA, 21 nt, Artificial Sequence
  Description of Artificial Sequence: Synthetic oligonucleotide
uaguaaggcaaaagggaacuu

SEQ ID NO: 31695 - RNA, 21 nt, Artificial Sequence
  Description of Artificial Sequence: Synthetic oligonucleotide
uuaguaaggcaaaagggaauu

SEQ ID NO: 31696 - RNA, 21 nt, Artificial Sequence
  Description of Artificial Sequence: Synthetic oligonucleotide
uauaguaaggcaaaagggauu

SEQ ID NO: 31697 - RNA, 21 nt, Artificial Sequence
  Description of Artificial Sequence: Synthetic oligonucleotide
uuauaguaaggcaaaaggguu

SEQ ID NO: 31698 - RNA, 21 nt, Artificial Sequence
  Description of Artificial Sequence: Synthetic oligonucleotide
uauauaguaaggcaaaagguu

SEQ ID NO: 31699 - RNA, 21 nt, Artificial Sequence
  Description of Artificial Sequence: Synthetic oligonucleotide
ucauauaguaaggcaaaaguu

SEQ ID NO: 31700 - RNA, 21 nt, Artificial Sequence
  Description of Artificial Sequence: Synthetic oligonucleotide
uacauauaguaaggcaaaauu

SEQ ID NO: 31701 - RNA, 21 nt, Artificial Sequence
  Description of Artificial Sequence: Synthetic oligonucleotide
uaacauauaguaaggcaaauu

SEQ ID NO: 31702 - RNA, 21 nt, Artificial Sequence
  Description of Artificial Sequence: Synthetic oligonucleotide
ugaacauauaguaaggcaauu

SEQ ID NO: 31703 - RNA, 21 nt, Artificial Sequence
  Description of Artificial Sequence: Synthetic oligonucleotide
uagaacauauaguaaggcauu

SEQ ID NO: 31704 - RNA, 21 nt, Artificial Sequence
  Description of Artificial Sequence: Synthetic oligonucleotide
ucagaacauauaguaaggcuu

SEQ ID NO: 31705 - RNA, 21 nt, Artificial Sequence
  Description of Artificial Sequence: Synthetic oligonucleotide
uacagaacauauaguaagguu

SEQ ID NO: 31706 - RNA, 21 nt, Artificial Sequence
  Description of Artificial Sequence: Synthetic oligonucleotide
ugacagaacauauaguaaguu

SEQ ID NO: 31707 - RNA, 21 nt, Artificial Sequence
  Description of Artificial Sequence: Synthetic oligonucleotide
uugacagaacauauaguaauu

SEQ ID NO: 31708 - RNA, 21 nt, Artificial Sequence
  Description of Artificial Sequence: Synthetic oligonucleotide
ucugacagaacauauaguauu

SEQ ID NO: 31709 - RNA, 21 nt, Artificial Sequence
  Description of Artificial Sequence: Synthetic oligonucleotide
uacugacagaacauauaguuu

SEQ ID NO: 31710 - RNA, 21 nt, Artificial Sequence
  Description of Artificial Sequence: Synthetic oligonucleotide
uaacugacagaacauauaguu

SEQ ID NO: 31711 - RNA, 21 nt, Artificial Sequence
  Description of Artificial Sequence: Synthetic oligonucleotide
uaaacugacagaacauauauu

SEQ ID NO: 31712 - RNA, 21 nt, Artificial Sequence
  Description of Artificial Sequence: Synthetic oligonucleotide
ugaaacugacagaacauauuu

SEQ ID NO: 31713 - RNA, 21 nt, Artificial Sequence
  Description of Artificial Sequence: Synthetic oligonucleotide
uagaaacugacagaacauauu

SEQ ID NO: 31714 - RNA, 21 nt, Artificial Sequence
  Description of Artificial Sequence: Synthetic oligonucleotide
uaagaaacugacagaacauuu

SEQ ID NO: 31715 - RNA, 21 nt, Artificial Sequence
  Description of Artificial Sequence: Synthetic oligonucleotide
uaaagaaacugacagaacauu

SEQ ID NO: 31716 - RNA, 21 nt, Artificial Sequence
  Description of Artificial Sequence: Synthetic oligonucleotide
ugaaagaaacugacagaacuu

SEQ ID NO: 31717 - RNA, 21 nt, Artificial Sequence
  Description of Artificial Sequence: Synthetic oligonucleotide
uugaaagaaacugacagaauu

SEQ ID NO: 31718 - RNA, 21 nt, Artificial Sequence
  Description of Artificial Sequence: Synthetic oligonucleotide
ucugaaagaaacugacagauu

SEQ ID NO: 31719 - RNA, 21 nt, Artificial Sequence
  Description of Artificial Sequence: Synthetic oligonucleotide
uccugaaagaaacugacaguu

SEQ ID NO: 31720 - RNA, 21 nt, Artificial Sequence
  Description of Artificial Sequence: Synthetic oligonucleotide
uuccugaaagaaacugacauu

SEQ ID NO: 31721 - RNA, 21 nt, Artificial Sequence
  Description of Artificial Sequence: Synthetic oligonucleotide
uuuccugaaagaaacugacuu

SEQ ID NO: 31722 - RNA, 21 nt, Artificial Sequence
  Description of Artificial Sequence: Synthetic oligonucleotide
uuuuccugaaagaaacugauu

SEQ ID NO: 31723 - RNA, 21 nt, Artificial Sequence
  Description of Artificial Sequence: Synthetic oligonucleotide
uuuuuccugaaagaaacuguu

SEQ ID NO: 31724 - RNA, 21 nt, Artificial Sequence
  Description of Artificial Sequence: Synthetic oligonucleotide
uauuuuccugaaagaaacuuu

SEQ ID NO: 31725 - RNA, 21 nt, Artificial Sequence
  Description of Artificial Sequence: Synthetic oligonucleotide
ugauuuuccugaaagaaacuu

SEQ ID NO: 31726 - RNA, 21 nt, Artificial Sequence
  Description of Artificial Sequence: Synthetic oligonucleotide
uagauuuuccugaaagaaauu

SEQ ID NO: 31727 - RNA, 21 nt, Artificial Sequence
  Description of Artificial Sequence: Synthetic oligonucleotide
uaagauuuuccugaaagaauu

SEQ ID NO: 31728 - RNA, 21 nt, Artificial Sequence
  Description of Artificial Sequence: Synthetic oligonucleotide
ugaagauuuuccugaaagauu

SEQ ID NO: 31729 - RNA, 21 nt, Artificial Sequence
  Description of Artificial Sequence: Synthetic oligonucleotide
uugaagauuuuccugaaaguu

SEQ ID NO: 31730 - RNA, 21 nt, Artificial Sequence
  Description of Artificial Sequence: Synthetic oligonucleotide
uaugaagauuuuccugaaauu

SEQ ID NO: 31731 - RNA, 21 nt, Artificial Sequence
  Description of Artificial Sequence: Synthetic oligonucleotide
ugaugaagauuuuccugaauu

SEQ ID NO: 31732 - RNA, 21 nt, Artificial Sequence
  Description of Artificial Sequence: Synthetic oligonucleotide
uagaugaagauuuuccugauu

SEQ ID NO: 31733 - RNA, 21 nt, Artificial Sequence
  Description of Artificial Sequence: Synthetic oligonucleotide
uaagaugaagauuuuccuguu

SEQ ID NO: 31734 - RNA, 21 nt, Artificial Sequence
  Description of Artificial Sequence: Synthetic oligonucleotide
uuaagaugaagauuuuccuuu

SEQ ID NO: 31735 - RNA, 21 nt, Artificial Sequence
  Description of Artificial Sequence: Synthetic oligonucleotide
uguaagaugaagauuuuccuu

SEQ ID NO: 31736 - RNA, 21 nt, Artificial Sequence
  Description of Artificial Sequence: Synthetic oligonucleotide
uuguaagaugaagauuuucuu

SEQ ID NO: 31737 - RNA, 21 nt, Artificial Sequence
  Description of Artificial Sequence: Synthetic oligonucleotide
uuuguaagaugaagauuuuuu

SEQ ID NO: 31738 - RNA, 21 nt, Artificial Sequence
  Description of Artificial Sequence: Synthetic oligonucleotide
uguuguaagaugaagauuuuu

SEQ ID NO: 31739 - RNA, 21 nt, Artificial Sequence
  Description of Artificial Sequence: Synthetic oligonucleotide
uaguuguaagaugaagauuuu

SEQ ID NO: 31740 - RNA, 21 nt, Artificial Sequence
  Description of Artificial Sequence: Synthetic oligonucleotide
uaaguuguaagaugaagauuu

SEQ ID NO: 31741 - RNA, 21 nt, Artificial Sequence
  Description of Artificial Sequence: Synthetic oligonucleotide
ucaaguuguaagaugaagauu

SEQ ID NO: 31742 - RNA, 21 nt, Artificial Sequence
  Description of Artificial Sequence: Synthetic oligonucleotide
uacaaguuguaagaugaaguu

SEQ ID NO: 31743 - RNA, 21 nt, Artificial Sequence
  Description of Artificial Sequence: Synthetic oligonucleotide
uuacaaguuguaagaugaauu

SEQ ID NO: 31744 - RNA, 21 nt, Artificial Sequence
  Description of Artificial Sequence: Synthetic oligonucleotide
ucuacaaguuguaagaugauu

SEQ ID NO: 31745 - RNA, 21 nt, Artificial Sequence
  Description of Artificial Sequence: Synthetic oligonucleotide
uccuacaaguuguaagauguu

SEQ ID NO: 31746 - RNA, 21 nt, Artificial Sequence
  Description of Artificial Sequence: Synthetic oligonucleotide
ucccuacaaguuguaagauuu

SEQ ID NO: 31747 - RNA, 21 nt, Artificial Sequence
  Description of Artificial Sequence: Synthetic oligonucleotide
ugcccuacaaguuguaagauu

SEQ ID NO: 31748 - RNA, 21 nt, Artificial Sequence
  Description of Artificial Sequence: Synthetic oligonucleotide
uagcccuacaaguuguaaguu

SEQ ID NO: 31749 - RNA, 21 nt, Artificial Sequence
  Description of Artificial Sequence: Synthetic oligonucleotide
ucagcccuacaaguuguaauu

SEQ ID NO: 31750 - RNA, 21 nt, Artificial Sequence
  Description of Artificial Sequence: Synthetic oligonucleotide
uccagcccuacaaguuguauu

SEQ ID NO: 31751 - RNA, 21 nt, Artificial Sequence
  Description of Artificial Sequence: Synthetic oligonucleotide
uaccagcccuacaaguuguuu

SEQ ID NO: 31752 - RNA, 21 nt, Artificial Sequence
  Description of Artificial Sequence: Synthetic oligonucleotide
ucaccagcccuacaaguuguu

SEQ ID NO: 31753 - RNA, 21 nt, Artificial Sequence
  Description of Artificial Sequence: Synthetic oligonucleotide
uacaccagcccuacaaguuuu

SEQ ID NO: 31754 - RNA, 21 nt, Artificial Sequence
  Description of Artificial Sequence: Synthetic oligonucleotide
uaacaccagcccuacaaguuu

SEQ ID NO: 31755 - RNA, 21 nt, Artificial Sequence
  Description of Artificial Sequence: Synthetic oligonucleotide
uuaacaccagcccuacaaguu

SEQ ID NO: 31756 - RNA, 21 nt, Artificial Sequence
  Description of Artificial Sequence: Synthetic oligonucleotide
uuuaacaccagcccuacaauu

SEQ ID NO: 31757 - RNA, 21 nt, Artificial Sequence
  Description of Artificial Sequence: Synthetic oligonucleotide
uguuaacaccagcccuacauu

SEQ ID NO: 31758 - RNA, 21 nt, Artificial Sequence
  Description of Artificial Sequence: Synthetic oligonucleotide
uaguuaacaccagcccuacuu

SEQ ID NO: 31759 - RNA, 21 nt, Artificial Sequence
  Description of Artificial Sequence: Synthetic oligonucleotide
uaaguuaacaccagcccuauu

SEQ ID NO: 31760 - RNA, 21 nt, Artificial Sequence
  Description of Artificial Sequence: Synthetic oligonucleotide
uuaaguuaacaccagcccuuu

SEQ ID NO: 31761 - RNA, 21 nt, Artificial Sequence
  Description of Artificial Sequence: Synthetic oligonucleotide
uguaaguuaacaccagcccuu

SEQ ID NO: 31762 - RNA, 21 nt, Artificial Sequence
  Description of Artificial Sequence: Synthetic oligonucleotide
ucguaaguuaacaccagccuu

SEQ ID NO: 31763 - RNA, 21 nt, Artificial Sequence
  Description of Artificial Sequence: Synthetic oligonucleotide
uucguaaguuaacaccagcuu

SEQ ID NO: 31764 - RNA, 21 nt, Artificial Sequence
  Description of Artificial Sequence: Synthetic oligonucleotide
ugucguaaguuaacaccaguu

SEQ ID NO: 31765 - RNA, 21 nt, Artificial Sequence
  Description of Artificial Sequence: Synthetic oligonucleotide
uagucguaaguuaacaccauu

SEQ ID NO: 31766 - RNA, 21 nt, Artificial Sequence
  Description of Artificial Sequence: Synthetic oligonucleotide
uaagucguaaguuaacaccuu

SEQ ID NO: 31767 - RNA, 21 nt, Artificial Sequence
  Description of Artificial Sequence: Synthetic oligonucleotide
ugaagucguaaguuaacacuu

SEQ ID NO: 31768 - RNA, 21 nt, Artificial Sequence
  Description of Artificial Sequence: Synthetic oligonucleotide
uugaagucguaaguuaacauu

SEQ ID NO: 31769 - RNA, 21 nt, Artificial Sequence
  Description of Artificial Sequence: Synthetic oligonucleotide
ugugaagucguaaguuaacuu

SEQ ID NO: 31770 - RNA, 21 nt, Artificial Sequence
  Description of Artificial Sequence: Synthetic oligonucleotide
uagugaagucguaaguuaauu

SEQ ID NO: 31771 - RNA, 21 nt, Artificial Sequence
  Description of Artificial Sequence: Synthetic oligonucleotide
uuagugaagucguaaguuauu

SEQ ID NO: 31772 - RNA, 21 nt, Artificial Sequence
  Description of Artificial Sequence: Synthetic oligonucleotide
uuuagugaagucguaaguuuu

SEQ ID NO: 31773 - RNA, 21 nt, Artificial Sequence
  Description of Artificial Sequence: Synthetic oligonucleotide
uguuagugaagucguaaguuu

SEQ ID NO: 31774 - RNA, 21 nt, Artificial Sequence
  Description of Artificial Sequence: Synthetic oligonucleotide
uaguuagugaagucguaaguu

SEQ ID NO: 31775 - RNA, 21 nt, Artificial Sequence
  Description of Artificial Sequence: Synthetic oligonucleotide
ucaguuagugaagucguaauu

SEQ ID NO: 31776 - RNA, 21 nt, Artificial Sequence
  Description of Artificial Sequence: Synthetic oligonucleotide
uacaguuagugaagucguauu

SEQ ID NO: 31777 - RNA, 21 nt, Artificial Sequence
  Description of Artificial Sequence: Synthetic oligonucleotide
ucacaguuagugaagucguuu

SEQ ID NO: 31778 - RNA, 21 nt, Artificial Sequence
  Description of Artificial Sequence: Synthetic oligonucleotide
uucacaguuagugaagucguu

SEQ ID NO: 31779 - RNA, 21 nt, Artificial Sequence
  Description of Artificial Sequence: Synthetic oligonucleotide
ugucacaguuagugaagucuu

SEQ ID NO: 31780 - RNA, 21 nt, Artificial Sequence
  Description of Artificial Sequence: Synthetic oligonucleotide
uagucacaguuagugaaguuu

SEQ ID NO: 31781 - RNA, 21 nt, Artificial Sequence
  Description of Artificial Sequence: Synthetic oligonucleotide
uaagucacaguuagugaaguu

SEQ ID NO: 31782 - RNA, 21 nt, Artificial Sequence
  Description of Artificial Sequence: Synthetic oligonucleotide
uaaagucacaguuagugaauu

SEQ ID NO: 31783 - RNA, 21 nt, Artificial Sequence
  Description of Artificial Sequence: Synthetic oligonucleotide
ucaaagucacaguuagugauu

SEQ ID NO: 31784 - RNA, 21 nt, Artificial Sequence
  Description of Artificial Sequence: Synthetic oligonucleotide
uucaaagucacaguuaguguu

SEQ ID NO: 31785 - RNA, 21 nt, Artificial Sequence
  Description of Artificial Sequence: Synthetic oligonucleotide
ucucaaagucacaguuaguuu

SEQ ID NO: 31786 - RNA, 21 nt, Artificial Sequence
  Description of Artificial Sequence: Synthetic oligonucleotide
uucucaaagucacaguuaguu

SEQ ID NO: 31787 - RNA, 21 nt, Artificial Sequence
  Description of Artificial Sequence: Synthetic oligonucleotide
uuucucaaagucacaguuauu

SEQ ID NO: 31788 - RNA, 21 nt, Artificial Sequence
  Description of Artificial Sequence: Synthetic oligonucleotide
ucuucucaaagucacaguuuu

SEQ ID NO: 31789 - RNA, 21 nt, Artificial Sequence
  Description of Artificial Sequence: Synthetic oligonucleotide
uucuucucaaagucacaguuu

SEQ ID NO: 31790 - RNA, 21 nt, Artificial Sequence
  Description of Artificial Sequence: Synthetic oligonucleotide
uaucuucucaaagucacaguu

SEQ ID NO: 31791 - RNA, 21 nt, Artificial Sequence
  Description of Artificial Sequence: Synthetic oligonucleotide
uaaucuucucaaagucacauu

SEQ ID NO: 31792 - RNA, 21 nt, Artificial Sequence
  Description of Artificial Sequence: Synthetic oligonucleotide
uuaaucuucucaaagucacuu

SEQ ID NO: 31793 - RNA, 21 nt, Artificial Sequence
  Description of Artificial Sequence: Synthetic oligonucleotide
uuuaaucuucucaaagucauu

SEQ ID NO: 31794 - RNA, 21 nt, Artificial Sequence
  Description of Artificial Sequence: Synthetic oligonucleotide
uuuuaaucuucucaaagucuu

SEQ ID NO: 31795 - RNA, 21 nt, Artificial Sequence
  Description of Artificial Sequence: Synthetic oligonucleotide
ucuuuaaucuucucaaaguuu

SEQ ID NO: 31796 - RNA, 21 nt, Artificial Sequence
  Description of Artificial Sequence: Synthetic oligonucleotide
ugcuuuaaucuucucaaaguu

SEQ ID NO: 31797 - RNA, 21 nt, Artificial Sequence
  Description of Artificial Sequence: Synthetic oligonucleotide
uugcuuuaaucuucucaaauu

SEQ ID NO: 31798 - RNA, 21 nt, Artificial Sequence
  Description of Artificial Sequence: Synthetic oligonucleotide
ucugcuuuaaucuucucaauu

SEQ ID NO: 31799 - RNA, 21 nt, Artificial Sequence
  Description of Artificial Sequence: Synthetic oligonucleotide
ugcugcuuuaaucuucucauu

SEQ ID NO: 31800 - RNA, 21 nt, Artificial Sequence
  Description of Artificial Sequence: Synthetic oligonucleotide
uggcugcuuuaaucuucucuu

SEQ ID NO: 31801 - RNA, 21 nt, Artificial Sequence
  Description of Artificial Sequence: Synthetic oligonucleotide
uaggcugcuuuaaucuucuuu

SEQ ID NO: 31802 - RNA, 21 nt, Artificial Sequence
  Description of Artificial Sequence: Synthetic oligonucleotide
uuaggcugcuuuaaucuucuu

SEQ ID NO: 31803 - RNA, 21 nt, Artificial Sequence
  Description of Artificial Sequence: Synthetic oligonucleotide
uauaggcugcuuuaaucuuuu

SEQ ID NO: 31804 - RNA, 21 nt, Artificial Sequence
  Description of Artificial Sequence: Synthetic oligonucleotide
ugauaggcugcuuuaaucuuu

SEQ ID NO: 31805 - RNA, 21 nt, Artificial Sequence
  Description of Artificial Sequence: Synthetic oligonucleotide
uagauaggcugcuuuaaucuu

SEQ ID NO: 31806 - RNA, 21 nt, Artificial Sequence
  Description of Artificial Sequence: Synthetic oligonucleotide
ugagauaggcugcuuuaauuu

SEQ ID NO: 31807 - RNA, 21 nt, Artificial Sequence
  Description of Artificial Sequence: Synthetic oligonucleotide
uugagauaggcugcuuuaauu

SEQ ID NO: 31808 - RNA, 21 nt, Artificial Sequence
  Description of Artificial Sequence: Synthetic oligonucleotide
ucugagauaggcugcuuuauu

SEQ ID NO: 31809 - RNA, 21 nt, Artificial Sequence
  Description of Artificial Sequence: Synthetic oligonucleotide
uacugagauaggcugcuuuuu

SEQ ID NO: 31810 - RNA, 21 nt, Artificial Sequence
  Description of Artificial Sequence: Synthetic oligonucleotide
uuacugagauaggcugcuuuu

SEQ ID NO: 31811 - RNA, 21 nt, Artificial Sequence
  Description of Artificial Sequence: Synthetic oligonucleotide
uguacugagauaggcugcuuu

SEQ ID NO: 31812 - RNA, 21 nt, Artificial Sequence
  Description of Artificial Sequence: Synthetic oligonucleotide
uaguacugagauaggcugcuu

SEQ ID NO: 31813 - RNA, 21 nt, Artificial Sequence
  Description of Artificial Sequence: Synthetic oligonucleotide
uuaguacugagauaggcuguu

SEQ ID NO: 31814 - RNA, 21 nt, Artificial Sequence
  Description of Artificial Sequence: Synthetic oligonucleotide
uauaguacugagauaggcuuu

SEQ ID NO: 31815 - RNA, 21 nt, Artificial Sequence
  Description of Artificial Sequence: Synthetic oligonucleotide
uaauaguacugagauaggcuu

SEQ ID NO: 31816 - RNA, 21 nt, Artificial Sequence
  Description of Artificial Sequence: Synthetic oligonucleotide
uaaauaguacugagauagguu

SEQ ID NO: 31817 - RNA, 21 nt, Artificial Sequence
  Description of Artificial Sequence: Synthetic oligonucleotide
ugaaauaguacugagauaguu

SEQ ID NO: 31818 - RNA, 21 nt, Artificial Sequence
  Description of Artificial Sequence: Synthetic oligonucleotide
uagaaauaguacugagauauu

SEQ ID NO: 31819 - RNA, 21 nt, Artificial Sequence
  Description of Artificial Sequence: Synthetic oligonucleotide
uuagaaauaguacugagauuu

SEQ ID NO: 31820 - RNA, 21 nt, Artificial Sequence
  Description of Artificial Sequence: Synthetic oligonucleotide
uuuagaaauaguacugagauu

SEQ ID NO: 31821 - RNA, 21 nt, Artificial Sequence
  Description of Artificial Sequence: Synthetic oligonucleotide
uuuuagaaauaguacugaguu

SEQ ID NO: 31822 - RNA, 21 nt, Artificial Sequence
  Description of Artificial Sequence: Synthetic oligonucleotide
ucuuuagaaauaguacugauu

SEQ ID NO: 31823 - RNA, 21 nt, Artificial Sequence
  Description of Artificial Sequence: Synthetic oligonucleotide
uucuuuagaaauaguacuguu

SEQ ID NO: 31824 - RNA, 21 nt, Artificial Sequence
  Description of Artificial Sequence: Synthetic oligonucleotide
ugucuuuagaaauaguacuuu

SEQ ID NO: 31825 - RNA, 21 nt, Artificial Sequence
  Description of Artificial Sequence: Synthetic oligonucleotide
uggucuuuagaaauaguacuu

SEQ ID NO: 31826 - RNA, 21 nt, Artificial Sequence
  Description of Artificial Sequence: Synthetic oligonucleotide
uaggucuuuagaaauaguauu

SEQ ID NO: 31827 - RNA, 21 nt, Artificial Sequence
  Description of Artificial Sequence: Synthetic oligonucleotide
ucaggucuuuagaaauaguuu

SEQ ID NO: 31828 - RNA, 21 nt, Artificial Sequence
  Description of Artificial Sequence: Synthetic oligonucleotide
uucaggucuuuagaaauaguu

SEQ ID NO: 31829 - RNA, 21 nt, Artificial Sequence
  Description of Artificial Sequence: Synthetic oligonucleotide
uaucaggucuuuagaaauauu

SEQ ID NO: 31830 - RNA, 21 nt, Artificial Sequence
  Description of Artificial Sequence: Synthetic oligonucleotide
uaaucaggucuuuagaaauuu

SEQ ID NO: 31831 - RNA, 21 nt, Artificial Sequence
  Description of Artificial Sequence: Synthetic oligonucleotide
uuaaucaggucuuuagaaauu

SEQ ID NO: 31832 - RNA, 21 nt, Artificial Sequence
  Description of Artificial Sequence: Synthetic oligonucleotide
uguaaucaggucuuuagaauu

SEQ ID NO: 31833 - RNA, 21 nt, Artificial Sequence
  Description of Artificial Sequence: Synthetic oligonucleotide
uuguaaucaggucuuuagauu

SEQ ID NO: 31834 - RNA, 21 nt, Artificial Sequence
  Description of Artificial Sequence: Synthetic oligonucleotide
uauguaaucaggucuuuaguu

SEQ ID NO: 31835 - RNA, 21 nt, Artificial Sequence
  Description of Artificial Sequence: Synthetic oligonucleotide
uuauguaaucaggucuuuauu

SEQ ID NO: 31836 - RNA, 21 nt, Artificial Sequence
  Description of Artificial Sequence: Synthetic oligonucleotide
uauauguaaucaggucuuuuu

SEQ ID NO: 31837 - RNA, 21 nt, Artificial Sequence
  Description of Artificial Sequence: Synthetic oligonucleotide
uuauauguaaucaggucuuuu

SEQ ID NO: 31838 - RNA, 21 nt, Artificial Sequence
  Description of Artificial Sequence: Synthetic oligonucleotide
uauauauguaaucaggucuuu

SEQ ID NO: 31839 - RNA, 21 nt, Artificial Sequence
  Description of Artificial Sequence: Synthetic oligonucleotide
ucauauauguaaucaggucuu

SEQ ID NO: 31840 - RNA, 21 nt, Artificial Sequence
  Description of Artificial Sequence: Synthetic oligonucleotide
uucauauauguaaucagguuu

SEQ ID NO: 31841 - RNA, 21 nt, Artificial Sequence
  Description of Artificial Sequence: Synthetic oligonucleotide
ucucauauauguaaucagguu

SEQ ID NO: 31842 - RNA, 21 nt, Artificial Sequence
  Description of Artificial Sequence: Synthetic oligonucleotide
uacucauauauguaaucaguu

SEQ ID NO: 31843 - RNA, 21 nt, Artificial Sequence
  Description of Artificial Sequence: Synthetic oligonucleotide
ucacucauauauguaaucauu

SEQ ID NO: 31844 - RNA, 21 nt, Artificial Sequence
  Description of Artificial Sequence: Synthetic oligonucleotide
uccacucauauauguaaucuu

SEQ ID NO: 31845 - RNA, 21 nt, Artificial Sequence
  Description of Artificial Sequence: Synthetic oligonucleotide
ucccacucauauauguaauuu

SEQ ID NO: 31846 - RNA, 21 nt, Artificial Sequence
  Description of Artificial Sequence: Synthetic oligonucleotide
uucccacucauauauguaauu

SEQ ID NO: 31847 - RNA, 21 nt, Artificial Sequence
  Description of Artificial Sequence: Synthetic oligonucleotide
ugucccacucauauauguauu

SEQ ID NO: 31848 - RNA, 21 nt, Artificial Sequence
  Description of Artificial Sequence: Synthetic oligonucleotide
uggucccacucauauauguuu

SEQ ID NO: 31849 - RNA, 21 nt, Artificial Sequence
  Description of Artificial Sequence: Synthetic oligonucleotide
uuggucccacucauauauguu

SEQ ID NO: 31850 - RNA, 21 nt, Artificial Sequence
  Description of Artificial Sequence: Synthetic oligonucleotide
uuuggucccacucauauauuu

SEQ ID NO: 31851 - RNA, 21 nt, Artificial Sequence
  Description of Artificial Sequence: Synthetic oligonucleotide
uuuuggucccacucauauauu

SEQ ID NO: 31852 - RNA, 21 nt, Artificial Sequence
  Description of Artificial Sequence: Synthetic oligonucleotide
uuuuuggucccacucauauuu

SEQ ID NO: 31853 - RNA, 21 nt, Artificial Sequence
  Description of Artificial Sequence: Synthetic oligonucleotide
ucuuuuggucccacucauauu

SEQ ID NO: 31854 - RNA, 21 nt, Artificial Sequence
  Description of Artificial Sequence: Synthetic oligonucleotide
uacuuuuggucccacucauuu

SEQ ID NO: 31855 - RNA, 21 nt, Artificial Sequence
  Description of Artificial Sequence: Synthetic oligonucleotide
uuacuuuuggucccacucauu

SEQ ID NO: 31856 - RNA, 21 nt, Artificial Sequence
  Description of Artificial Sequence: Synthetic oligonucleotide
uguacuuuuggucccacucuu

SEQ ID NO: 31857 - RNA, 21 nt, Artificial Sequence
  Description of Artificial Sequence: Synthetic oligonucleotide
ugguacuuuuggucccacuuu

SEQ ID NO: 31858 - RNA, 21 nt, Artificial Sequence
  Description of Artificial Sequence: Synthetic oligonucleotide
ucgguacuuuuggucccacuu

SEQ ID NO: 31859 - RNA, 21 nt, Artificial Sequence
  Description of Artificial Sequence: Synthetic oligonucleotide
uucgguacuuuuggucccauu

SEQ ID NO: 31860 - RNA, 21 nt, Artificial Sequence
  Description of Artificial Sequence: Synthetic oligonucleotide
ucucgguacuuuuggucccuu

SEQ ID NO: 31861 - RNA, 21 nt, Artificial Sequence
  Description of Artificial Sequence: Synthetic oligonucleotide
uacucgguacuuuugguccuu

SEQ ID NO: 31862 - RNA, 21 nt, Artificial Sequence
  Description of Artificial Sequence: Synthetic oligonucleotide
uaacucgguacuuuuggucuu

SEQ ID NO: 31863 - RNA, 21 nt, Artificial Sequence
  Description of Artificial Sequence: Synthetic oligonucleotide
ugaacucgguacuuuugguuu

SEQ ID NO: 31864 - RNA, 21 nt, Artificial Sequence
  Description of Artificial Sequence: Synthetic oligonucleotide
uugaacucgguacuuuugguu

SEQ ID NO: 31865 - RNA, 21 nt, Artificial Sequence
  Description of Artificial Sequence: Synthetic oligonucleotide
uuugaacucgguacuuuuguu

SEQ ID NO: 31866 - RNA, 21 nt, Artificial Sequence
  Description of Artificial Sequence: Synthetic oligonucleotide
uguugaacucgguacuuuuuu

SEQ ID NO: 31867 - RNA, 21 nt, Artificial Sequence
  Description of Artificial Sequence: Synthetic oligonucleotide
uuguugaacucgguacuuuuu

SEQ ID NO: 31868 - RNA, 21 nt, Artificial Sequence
  Description of Artificial Sequence: Synthetic oligonucleotide
uuuguugaacucgguacuuuu

SEQ ID NO: 31869 - RNA, 21 nt, Artificial Sequence
  Description of Artificial Sequence: Synthetic oligonucleotide
uguuguugaacucgguacuuu

SEQ ID NO: 31870 - RNA, 21 nt, Artificial Sequence
  Description of Artificial Sequence: Synthetic oligonucleotide
uuguuguugaacucgguacuu

SEQ ID NO: 31871 - RNA, 21 nt, Artificial Sequence
  Description of Artificial Sequence: Synthetic oligonucleotide
uguguuguugaacucgguauu

SEQ ID NO: 31872 - RNA, 21 nt, Artificial Sequence
  Description of Artificial Sequence: Synthetic oligonucleotide
ugguguuguugaacucgguuu

SEQ ID NO: 31873 - RNA, 21 nt, Artificial Sequence
  Description of Artificial Sequence: Synthetic oligonucleotide
ucgguguuguugaacucgguu

SEQ ID NO: 31874 - RNA, 21 nt, Artificial Sequence
  Description of Artificial Sequence: Synthetic oligonucleotide
uacgguguuguugaacucguu

SEQ ID NO: 31875 - RNA, 21 nt, Artificial Sequence
  Description of Artificial Sequence: Synthetic oligonucleotide
ugacgguguuguugaacucuu

SEQ ID NO: 31876 - RNA, 21 nt, Artificial Sequence
  Description of Artificial Sequence: Synthetic oligonucleotide
uagacgguguuguugaacuuu

SEQ ID NO: 31877 - RNA, 21 nt, Artificial Sequence
  Description of Artificial Sequence: Synthetic oligonucleotide
ugagacgguguuguugaacuu

SEQ ID NO: 31878 - RNA, 21 nt, Artificial Sequence
  Description of Artificial Sequence: Synthetic oligonucleotide
uagagacgguguuguugaauu

SEQ ID NO: 31879 - RNA, 21 nt, Artificial Sequence
  Description of Artificial Sequence: Synthetic oligonucleotide
uaagagacgguguuguugauu

SEQ ID NO: 31880 - RNA, 21 nt, Artificial Sequence
  Description of Artificial Sequence: Synthetic oligonucleotide
ucaagagacgguguuguuguu

SEQ ID NO: 31881 - RNA, 21 nt, Artificial Sequence
  Description of Artificial Sequence: Synthetic oligonucleotide
uacaagagacgguguuguuuu

SEQ ID NO: 31882 - RNA, 21 nt, Artificial Sequence
  Description of Artificial Sequence: Synthetic oligonucleotide
uuacaagagacgguguuguuu

SEQ ID NO: 31883 - RNA, 21 nt, Artificial Sequence
  Description of Artificial Sequence: Synthetic oligonucleotide
ucuacaagagacgguguuguu

SEQ ID NO: 31884 - RNA, 21 nt, Artificial Sequence
  Description of Artificial Sequence: Synthetic oligonucleotide
ugcuacaagagacgguguuuu

SEQ ID NO: 31885 - RNA, 21 nt, Artificial Sequence
  Description of Artificial Sequence: Synthetic oligonucleotide
uugcuacaagagacgguguuu

SEQ ID NO: 31886 - RNA, 21 nt, Artificial Sequence
  Description of Artificial Sequence: Synthetic oligonucleotide
uuugcuacaagagacgguguu

SEQ ID NO: 31887 - RNA, 21 nt, Artificial Sequence
  Description of Artificial Sequence: Synthetic oligonucleotide
uauugcuacaagagacgguuu

SEQ ID NO: 31888 - RNA, 21 nt, Artificial Sequence
  Description of Artificial Sequence: Synthetic oligonucleotide
ugauugcuacaagagacgguu

SEQ ID NO: 31889 - RNA, 21 nt, Artificial Sequence
  Description of Artificial Sequence: Synthetic oligonucleotide
ucgauugcuacaagagacguu

SEQ ID NO: 31890 - RNA, 21 nt, Artificial Sequence
  Description of Artificial Sequence: Synthetic oligonucleotide
uccgauugcuacaagagacuu

SEQ ID NO: 31891 - RNA, 21 nt, Artificial Sequence
  Description of Artificial Sequence: Synthetic oligonucleotide
ugccgauugcuacaagagauu

SEQ ID NO: 31892 - RNA, 21 nt, Artificial Sequence
  Description of Artificial Sequence: Synthetic oligonucleotide
uggccgauugcuacaagaguu

SEQ ID NO: 31893 - RNA, 21 nt, Artificial Sequence
  Description of Artificial Sequence: Synthetic oligonucleotide
uuggccgauugcuacaagauu

SEQ ID NO: 31894 - RNA, 21 nt, Artificial Sequence
  Description of Artificial Sequence: Synthetic oligonucleotide
uguggccgauugcuacaaguu

SEQ ID NO: 31895 - RNA, 21 nt, Artificial Sequence
  Description of Artificial Sequence: Synthetic oligonucleotide
uuguggccgauugcuacaauu

SEQ ID NO: 31896 - RNA, 21 nt, Artificial Sequence
  Description of Artificial Sequence: Synthetic oligonucleotide
uauguggccgauugcuacauu

SEQ ID NO: 31897 - RNA, 21 nt, Artificial Sequence
  Description of Artificial Sequence: Synthetic oligonucleotide
uaauguggccgauugcuacuu

SEQ ID NO: 31898 - RNA, 21 nt, Artificial Sequence
  Description of Artificial Sequence: Synthetic oligonucleotide
ucaauguggccgauugcuauu

SEQ ID NO: 31899 - RNA, 21 nt, Artificial Sequence
  Description of Artificial Sequence: Synthetic oligonucleotide
ugcaauguggccgauugcuuu

SEQ ID NO: 31900 - RNA, 21 nt, Artificial Sequence
  Description of Artificial Sequence: Synthetic oligonucleotide
uggcaauguggccgauugcuu

SEQ ID NO: 31901 - RNA, 21 nt, Artificial Sequence
  Description of Artificial Sequence: Synthetic oligonucleotide
uaggcaauguggccgauuguu

SEQ ID NO: 31902 - RNA, 21 nt, Artificial Sequence
  Description of Artificial Sequence: Synthetic oligonucleotide
uaaggcaauguggccgauuuu

SEQ ID NO: 31903 - RNA, 21 nt, Artificial Sequence
  Description of Artificial Sequence: Synthetic oligonucleotide
uuaaggcaauguggccgauuu

SEQ ID NO: 31904 - RNA, 21 nt, Artificial Sequence
  Description of Artificial Sequence: Synthetic oligonucleotide
uguaaggcaauguggccgauu

SEQ ID NO: 31905 - RNA, 21 nt, Artificial Sequence
  Description of Artificial Sequence: Synthetic oligonucleotide
uaguaaggcaauguggccguu

SEQ ID NO: 31906 - RNA, 21 nt, Artificial Sequence
  Description of Artificial Sequence: Synthetic oligonucleotide
ucaguaaggcaauguggccuu

SEQ ID NO: 31907 - RNA, 21 nt, Artificial Sequence
  Description of Artificial Sequence: Synthetic oligonucleotide
uucaguaaggcaauguggcuu

SEQ ID NO: 31908 - RNA, 21 nt, Artificial Sequence
  Description of Artificial Sequence: Synthetic oligonucleotide
uuucaguaaggcaaugugguu

SEQ ID NO: 31909 - RNA, 21 nt, Artificial Sequence
  Description of Artificial Sequence: Synthetic oligonucleotide
uuuucaguaaggcaauguguu

SEQ ID NO: 31910 - RNA, 21 nt, Artificial Sequence
  Description of Artificial Sequence: Synthetic oligonucleotide
uauuucaguaaggcaauguuu

SEQ ID NO: 31911 - RNA, 21 nt, Artificial Sequence
  Description of Artificial Sequence: Synthetic oligonucleotide
ugauuucaguaaggcaauguu

SEQ ID NO: 31912 - RNA, 21 nt, Artificial Sequence
  Description of Artificial Sequence: Synthetic oligonucleotide
uggauuucaguaaggcaauuu

SEQ ID NO: 31913 - RNA, 21 nt, Artificial Sequence
  Description of Artificial Sequence: Synthetic oligonucleotide
uuggauuucaguaaggcaauu

SEQ ID NO: 31914 - RNA, 21 nt, Artificial Sequence
  Description of Artificial Sequence: Synthetic oligonucleotide
ucuggauuucaguaaggcauu

SEQ ID NO: 31915 - RNA, 21 nt, Artificial Sequence
  Description of Artificial Sequence: Synthetic oligonucleotide
uucuggauuucaguaaggcuu

SEQ ID NO: 31916 - RNA, 21 nt, Artificial Sequence
  Description of Artificial Sequence: Synthetic oligonucleotide
ucucuggauuucaguaagguu

SEQ ID NO: 31917 - RNA, 21 nt, Artificial Sequence
  Description of Artificial Sequence: Synthetic oligonucleotide
ugcucuggauuucaguaaguu

SEQ ID NO: 31918 - RNA, 21 nt, Artificial Sequence
  Description of Artificial Sequence: Synthetic oligonucleotide
uggcucuggauuucaguaauu

SEQ ID NO: 31919 - RNA, 21 nt, Artificial Sequence
  Description of Artificial Sequence: Synthetic oligonucleotide
uaggcucuggauuucaguauu

SEQ ID NO: 31920 - RNA, 21 nt, Artificial Sequence
  Description of Artificial Sequence: Synthetic oligonucleotide
uuaggcucuggauuucaguuu

SEQ ID NO: 31921 - RNA, 21 nt, Artificial Sequence
  Description of Artificial Sequence: Synthetic oligonucleotide
uuuaggcucuggauuucaguu

SEQ ID NO: 31922 - RNA, 21 nt, Artificial Sequence
  Description of Artificial Sequence: Synthetic oligonucleotide
uguuaggcucuggauuucauu

SEQ ID NO: 31923 - RNA, 21 nt, Artificial Sequence
  Description of Artificial Sequence: Synthetic oligonucleotide
ugguuaggcucuggauuucuu

SEQ ID NO: 31924 - RNA, 21 nt, Artificial Sequence
  Description of Artificial Sequence: Synthetic oligonucleotide
uagguuaggcucuggauuuuu

SEQ ID NO: 31925 - RNA, 21 nt, Artificial Sequence
  Description of Artificial Sequence: Synthetic oligonucleotide
uaagguuaggcucuggauuuu

SEQ ID NO: 31926 - RNA, 21 nt, Artificial Sequence
  Description of Artificial Sequence: Synthetic oligonucleotide
ugaagguuaggcucuggauuu

SEQ ID NO: 31927 - RNA, 21 nt, Artificial Sequence
  Description of Artificial Sequence: Synthetic oligonucleotide
uugaagguuaggcucuggauu

SEQ ID NO: 31928 - RNA, 21 nt, Artificial Sequence
  Description of Artificial Sequence: Synthetic oligonucleotide
uuugaagguuaggcucugguu

SEQ ID NO: 31929 - RNA, 21 nt, Artificial Sequence
  Description of Artificial Sequence: Synthetic oligonucleotide
uauugaagguuaggcucuguu

SEQ ID NO: 31930 - RNA, 21 nt, Artificial Sequence
  Description of Artificial Sequence: Synthetic oligonucleotide
ugauugaagguuaggcucuuu

SEQ ID NO: 31931 - RNA, 21 nt, Artificial Sequence
  Description of Artificial Sequence: Synthetic oligonucleotide
uggauugaagguuaggcucuu

SEQ ID NO: 31932 - RNA, 21 nt, Artificial Sequence
  Description of Artificial Sequence: Synthetic oligonucleotide
ugggauugaagguuaggcuuu

SEQ ID NO: 31933 - RNA, 21 nt, Artificial Sequence
  Description of Artificial Sequence: Synthetic oligonucleotide
uugggauugaagguuaggcuu

SEQ ID NO: 31934 - RNA, 21 nt, Artificial Sequence
  Description of Artificial Sequence: Synthetic oligonucleotide
ugugggauugaagguuagguu

SEQ ID NO: 31935 - RNA, 21 nt, Artificial Sequence
  Description of Artificial Sequence: Synthetic oligonucleotide
uggugggauugaagguuaguu

SEQ ID NO: 31936 - RNA, 21 nt, Artificial Sequence
  Description of Artificial Sequence: Synthetic oligonucleotide
ucggugggauugaagguuauu

SEQ ID NO: 31937 - RNA, 21 nt, Artificial Sequence
  Description of Artificial Sequence: Synthetic oligonucleotide
ugcggugggauugaagguuuu

SEQ ID NO: 31938 - RNA, 21 nt, Artificial Sequence
  Description of Artificial Sequence: Synthetic oligonucleotide
uggcggugggauugaagguuu

SEQ ID NO: 31939 - RNA, 21 nt, Artificial Sequence
  Description of Artificial Sequence: Synthetic oligonucleotide
ucggcggugggauugaagguu

SEQ ID NO: 31940 - RNA, 21 nt, Artificial Sequence
  Description of Artificial Sequence: Synthetic oligonucleotide
uccggcggugggauugaaguu

SEQ ID NO: 31941 - RNA, 21 nt, Artificial Sequence
  Description of Artificial Sequence: Synthetic oligonucleotide
ugccggcggugggauugaauu

SEQ ID NO: 31942 - RNA, 21 nt, Artificial Sequence
  Description of Artificial Sequence: Synthetic oligonucleotide
uagccggcggugggauugauu

SEQ ID NO: 31943 - RNA, 21 nt, Artificial Sequence
  Description of Artificial Sequence: Synthetic oligonucleotide
ucagccggcggugggauuguu

SEQ ID NO: 31944 - RNA, 21 nt, Artificial Sequence
  Description of Artificial Sequence: Synthetic oligonucleotide
ugcagccggcggugggauuuu

SEQ ID NO: 31945 - RNA, 21 nt, Artificial Sequence
  Description of Artificial Sequence: Synthetic oligonucleotide
ucgcagccggcggugggauuu

SEQ ID NO: 31946 - RNA, 21 nt, Artificial Sequence
  Description of Artificial Sequence: Synthetic oligonucleotide
ugcgcagccggcggugggauu

SEQ ID NO: 31947 - RNA, 21 nt, Artificial Sequence
  Description of Artificial Sequence: Synthetic oligonucleotide
ucgcgcagccggcgguggguu

SEQ ID NO: 31948 - RNA, 21 nt, Artificial Sequence
  Description of Artificial Sequence: Synthetic oligonucleotide
uacgcgcagccggcggugguu

SEQ ID NO: 31949 - RNA, 21 nt, Artificial Sequence
  Description of Artificial Sequence: Synthetic oligonucleotide
ugacgcgcagccggcgguguu

SEQ ID NO: 31950 - RNA, 21 nt, Artificial Sequence
  Description of Artificial Sequence: Synthetic oligonucleotide
ucgacgcgcagccggcgguuu

SEQ ID NO: 31951 - RNA, 21 nt, Artificial Sequence
  Description of Artificial Sequence: Synthetic oligonucleotide
ugcgacgcgcagccggcgguu

SEQ ID NO: 31952 - RNA, 21 nt, Artificial Sequence
  Description of Artificial Sequence: Synthetic oligonucleotide
uagcgacgcgcagccggcguu

SEQ ID NO: 31953 - RNA, 21 nt, Artificial Sequence
  Description of Artificial Sequence: Synthetic oligonucleotide
ugagcgacgcgcagccggcuu

SEQ ID NO: 31954 - RNA, 21 nt, Artificial Sequence
  Description of Artificial Sequence: Synthetic oligonucleotide
ucgagcgacgcgcagccgguu

SEQ ID NO: 31955 - RNA, 21 nt, Artificial Sequence
  Description of Artificial Sequence: Synthetic oligonucleotide
ugcgagcgacgcgcagccguu

SEQ ID NO: 31956 - RNA, 21 nt, Artificial Sequence
  Description of Artificial Sequence: Synthetic oligonucleotide
uggcgagcgacgcgcagccuu

SEQ ID NO: 31957 - RNA, 21 nt, Artificial Sequence
  Description of Artificial Sequence: Synthetic oligonucleotide
uuggcgagcgacgcgcagcuu

SEQ ID NO: 31958 - RNA, 21 nt, Artificial Sequence
  Description of Artificial Sequence: Synthetic oligonucleotide
uuuggcgagcgacgcgcaguu

SEQ ID NO: 31959 - RNA, 21 nt, Artificial Sequence
  Description of Artificial Sequence: Synthetic oligonucleotide
uuuuggcgagcgacgcgcauu

SEQ ID NO: 31960 - RNA, 21 nt, Artificial Sequence
  Description of Artificial Sequence: Synthetic oligonucleotide
ucuuuggcgagcgacgcgcuu

SEQ ID NO: 31961 - RNA, 21 nt, Artificial Sequence
  Description of Artificial Sequence: Synthetic oligonucleotide
uucuuuggcgagcgacgcguu

SEQ ID NO: 31962 - RNA, 21 nt, Artificial Sequence
  Description of Artificial Sequence: Synthetic oligonucleotide
uuucuuuggcgagcgacgcuu

SEQ ID NO: 31963 - RNA, 21 nt, Artificial Sequence
  Description of Artificial Sequence: Synthetic oligonucleotide
uuuucuuuggcgagcgacguu

SEQ ID NO: 31964 - RNA, 21 nt, Artificial Sequence
  Description of Artificial Sequence: Synthetic oligonucleotide
uauuucuuuggcgagcgacuu

SEQ ID NO: 31965 - RNA, 21 nt, Artificial Sequence
  Description of Artificial Sequence: Synthetic oligonucleotide
ucauuucuuuggcgagcgauu

SEQ ID NO: 31966 - RNA, 21 nt, Artificial Sequence
  Description of Artificial Sequence: Synthetic oligonucleotide
uacauuucuuuggcgagcguu

SEQ ID NO: 31967 - RNA, 21 nt, Artificial Sequence
  Description of Artificial Sequence: Synthetic oligonucleotide
uaacauuucuuuggcgagcuu

SEQ ID NO: 31968 - RNA, 21 nt, Artificial Sequence
  Description of Artificial Sequence: Synthetic oligonucleotide
ugaacauuucuuuggcgaguu

SEQ ID NO: 31969 - RNA, 21 nt, Artificial Sequence
  Description of Artificial Sequence: Synthetic oligonucleotide
ucgaacauuucuuuggcgauu

SEQ ID NO: 31970 - RNA, 21 nt, Artificial Sequence
  Description of Artificial Sequence: Synthetic oligonucleotide
ugcgaacauuucuuuggcguu

SEQ ID NO: 31971 - RNA, 21 nt, Artificial Sequence
  Description of Artificial Sequence: Synthetic oligonucleotide
uggcgaacauuucuuuggcuu

SEQ ID NO: 31972 - RNA, 21 nt, Artificial Sequence
  Description of Artificial Sequence: Synthetic oligonucleotide
uuggcgaacauuucuuugguu

SEQ ID NO: 31973 - RNA, 21 nt, Artificial Sequence
  Description of Artificial Sequence: Synthetic oligonucleotide
uauggcgaacauuucuuuguu

SEQ ID NO: 31974 - RNA, 21 nt, Artificial Sequence
  Description of Artificial Sequence: Synthetic oligonucleotide
ucauggcgaacauuucuuuuu

SEQ ID NO: 31975 - RNA, 21 nt, Artificial Sequence
  Description of Artificial Sequence: Synthetic oligonucleotide
uucauggcgaacauuucuuuu

SEQ ID NO: 31976 - RNA, 21 nt, Artificial Sequence
  Description of Artificial Sequence: Synthetic oligonucleotide
uuucauggcgaacauuucuuu

SEQ ID NO: 31977 - RNA, 21 nt, Artificial Sequence
  Description of Artificial Sequence: Synthetic oligonucleotide
uuuucauggcgaacauuucuu

SEQ ID NO: 31978 - RNA, 21 nt, Artificial Sequence
  Description of Artificial Sequence: Synthetic oligonucleotide
uuuuucauggcgaacauuuuu

SEQ ID NO: 31979 - RNA, 21 nt, Artificial Sequence
  Description of Artificial Sequence: Synthetic oligonucleotide
uguuuucauggcgaacauuuu

SEQ ID NO: 31980 - RNA, 21 nt, Artificial Sequence
  Description of Artificial Sequence: Synthetic oligonucleotide
uaguuuucauggcgaacauuu

SEQ ID NO: 31981 - RNA, 21 nt, Artificial Sequence
  Description of Artificial Sequence: Synthetic oligonucleotide
uuaguuuucauggcgaacauu

SEQ ID NO: 31982 - RNA, 21 nt, Artificial Sequence
  Description of Artificial Sequence: Synthetic oligonucleotide
uuuaguuuucauggcgaacuu

SEQ ID NO: 31983 - RNA, 21 nt, Artificial Sequence
  Description of Artificial Sequence: Synthetic oligonucleotide
ucuuaguuuucauggcgaauu

SEQ ID NO: 31984 - RNA, 21 nt, Artificial Sequence
  Description of Artificial Sequence: Synthetic oligonucleotide
uccuuaguuuucauggcgauu

SEQ ID NO: 31985 - RNA, 21 nt, Artificial Sequence
  Description of Artificial Sequence: Synthetic oligonucleotide
ugccuuaguuuucauggcguu

SEQ ID NO: 31986 - RNA, 21 nt, Artificial Sequence
  Description of Artificial Sequence: Synthetic oligonucleotide
uagccuuaguuuucauggcuu

SEQ ID NO: 31987 - RNA, 21 nt, Artificial Sequence
  Description of Artificial Sequence: Synthetic oligonucleotide
ucagccuuaguuuucaugguu

SEQ ID NO: 31988 - RNA, 21 nt, Artificial Sequence
  Description of Artificial Sequence: Synthetic oligonucleotide
ugcagccuuaguuuucauguu

SEQ ID NO: 31989 - RNA, 21 nt, Artificial Sequence
  Description of Artificial Sequence: Synthetic oligonucleotide
uggcagccuuaguuuucauuu

SEQ ID NO: 31990 - RNA, 21 nt, Artificial Sequence
  Description of Artificial Sequence: Synthetic oligonucleotide
uaggcagccuuaguuuucauu

SEQ ID NO: 31991 - RNA, 21 nt, Artificial Sequence
  Description of Artificial Sequence: Synthetic oligonucleotide
uaaggcagccuuaguuuucuu

SEQ ID NO: 31992 - RNA, 21 nt, Artificial Sequence
  Description of Artificial Sequence: Synthetic oligonucleotide
uuaaggcagccuuaguuuuuu

SEQ ID NO: 31993 - RNA, 21 nt, Artificial Sequence
  Description of Artificial Sequence: Synthetic oligonucleotide
ucuaaggcagccuuaguuuuu

SEQ ID NO: 31994 - RNA, 21 nt, Artificial Sequence
  Description of Artificial Sequence: Synthetic oligonucleotide
ugcuaaggcagccuuaguuuu

SEQ ID NO: 31995 - RNA, 21 nt, Artificial Sequence
  Description of Artificial Sequence: Synthetic oligonucleotide
uagcuaaggcagccuuaguuu

SEQ ID NO: 31996 - RNA, 21 nt, Artificial Sequence
  Description of Artificial Sequence: Synthetic oligonucleotide
uuagcuaaggcagccuuaguu

SEQ ID NO: 31997 - RNA, 21 nt, Artificial Sequence
  Description of Artificial Sequence: Synthetic oligonucleotide
uauagcuaaggcagccuuauu

SEQ ID NO: 31998 - RNA, 21 nt, Artificial Sequence
  Description of Artificial Sequence: Synthetic oligonucleotide
ugauagcuaaggcagccuuuu

SEQ ID NO: 31999 - RNA, 21 nt, Artificial Sequence
  Description of Artificial Sequence: Synthetic oligonucleotide
uagauagcuaaggcagccuuu

SEQ ID NO: 32000 - RNA, 21 nt, Artificial Sequence
  Description of Artificial Sequence: Synthetic oligonucleotide
ucagauagcuaaggcagccuu

SEQ ID NO: 32001 - RNA, 21 nt, Artificial Sequence
  Description of Artificial Sequence: Synthetic oligonucleotide
uccagauagcuaaggcagcuu

SEQ ID NO: 32002 - RNA, 21 nt, Artificial Sequence
  Description of Artificial Sequence: Synthetic oligonucleotide
uaccagauagcuaaggcaguu

SEQ ID NO: 32003 - RNA, 21 nt, Artificial Sequence
  Description of Artificial Sequence: Synthetic oligonucleotide
ucaccagauagcuaaggcauu

SEQ ID NO: 32004 - RNA, 21 nt, Artificial Sequence
  Description of Artificial Sequence: Synthetic oligonucleotide
ugcaccagauagcuaaggcuu

SEQ ID NO: 32005 - RNA, 21 nt, Artificial Sequence
  Description of Artificial Sequence: Synthetic oligonucleotide
uggcaccagauagcuaagguu

SEQ ID NO: 32006 - RNA, 21 nt, Artificial Sequence
  Description of Artificial Sequence: Synthetic oligonucleotide
ugggcaccagauagcuaaguu

SEQ ID NO: 32007 - RNA, 21 nt, Artificial Sequence
  Description of Artificial Sequence: Synthetic oligonucleotide
uugggcaccagauagcuaauu

SEQ ID NO: 32008 - RNA, 21 nt, Artificial Sequence
  Description of Artificial Sequence: Synthetic oligonucleotide
ucugggcaccagauagcuauu

SEQ ID NO: 32009 - RNA, 21 nt, Artificial Sequence
  Description of Artificial Sequence: Synthetic oligonucleotide
uccugggcaccagauagcuuu

SEQ ID NO: 32010 - RNA, 21 nt, Artificial Sequence
  Description of Artificial Sequence: Synthetic oligonucleotide
ugccugggcaccagauagcuu

SEQ ID NO: 32011 - RNA, 21 nt, Artificial Sequence
  Description of Artificial Sequence: Synthetic oligonucleotide
uagccugggcaccagauaguu

SEQ ID NO: 32012 - RNA, 21 nt, Artificial Sequence
  Description of Artificial Sequence: Synthetic oligonucleotide
uuagccugggcaccagauauu

SEQ ID NO: 32013 - RNA, 21 nt, Artificial Sequence
  Description of Artificial Sequence: Synthetic oligonucleotide
uauagccugggcaccagauuu

SEQ ID NO: 32014 - RNA, 21 nt, Artificial Sequence
  Description of Artificial Sequence: Synthetic oligonucleotide
uaauagccugggcaccagauu

SEQ ID NO: 32015 - RNA, 21 nt, Artificial Sequence
  Description of Artificial Sequence: Synthetic oligonucleotide
ugaauagccugggcaccaguu

SEQ ID NO: 32016 - RNA, 21 nt, Artificial Sequence
  Description of Artificial Sequence: Synthetic oligonucleotide
ucgaauagccugggcaccauu

SEQ ID NO: 32017 - RNA, 21 nt, Artificial Sequence
  Description of Artificial Sequence: Synthetic oligonucleotide
uccgaauagccugggcaccuu

SEQ ID NO: 32018 - RNA, 21 nt, Artificial Sequence
  Description of Artificial Sequence: Synthetic oligonucleotide
uuccgaauagccugggcacuu

SEQ ID NO: 32019 - RNA, 21 nt, Artificial Sequence
  Description of Artificial Sequence: Synthetic oligonucleotide
uuuccgaauagccugggcauu

SEQ ID NO: 32020 - RNA, 21 nt, Artificial Sequence
  Description of Artificial Sequence: Synthetic oligonucleotide
uuuuccgaauagccugggcuu

SEQ ID NO: 32021 - RNA, 21 nt, Artificial Sequence
  Description of Artificial Sequence: Synthetic oligonucleotide
uguuuccgaauagccuggguu

SEQ ID NO: 32022 - RNA, 21 nt, Artificial Sequence
  Description of Artificial Sequence: Synthetic oligonucleotide
uaguuuccgaauagccugguu

SEQ ID NO: 32023 - RNA, 21 nt, Artificial Sequence
  Description of Artificial Sequence: Synthetic oligonucleotide
ugaguuuccgaauagccuguu

SEQ ID NO: 32024 - RNA, 21 nt, Artificial Sequence
  Description of Artificial Sequence: Synthetic oligonucleotide
uugaguuuccgaauagccuuu

SEQ ID NO: 32025 - RNA, 21 nt, Artificial Sequence
  Description of Artificial Sequence: Synthetic oligonucleotide
ucugaguuuccgaauagccuu

SEQ ID NO: 32026 - RNA, 21 nt, Artificial Sequence
  Description of Artificial Sequence: Synthetic oligonucleotide
uucugaguuuccgaauagcuu

SEQ ID NO: 32027 - RNA, 21 nt, Artificial Sequence
  Description of Artificial Sequence: Synthetic oligonucleotide
uaucugaguuuccgaauaguu

SEQ ID NO: 32028 - RNA, 21 nt, Artificial Sequence
  Description of Artificial Sequence: Synthetic oligonucleotide
uuaucugaguuuccgaauauu

SEQ ID NO: 32029 - RNA, 21 nt, Artificial Sequence
  Description of Artificial Sequence: Synthetic oligonucleotide
uuuaucugaguuuccgaauuu

SEQ ID NO: 32030 - RNA, 21 nt, Artificial Sequence
  Description of Artificial Sequence: Synthetic oligonucleotide
uuuuaucugaguuuccgaauu

SEQ ID NO: 32031 - RNA, 21 nt, Artificial Sequence
  Description of Artificial Sequence: Synthetic oligonucleotide
uauuuaucugaguuuccgauu

SEQ ID NO: 32032 - RNA, 21 nt, Artificial Sequence
  Description of Artificial Sequence: Synthetic oligonucleotide
ucauuuaucugaguuuccguu

SEQ ID NO: 32033 - RNA, 21 nt, Artificial Sequence
  Description of Artificial Sequence: Synthetic oligonucleotide
ugcauuuaucugaguuuccuu

SEQ ID NO: 32034 - RNA, 21 nt, Artificial Sequence
  Description of Artificial Sequence: Synthetic oligonucleotide
uagcauuuaucugaguuucuu

SEQ ID NO: 32035 - RNA, 21 nt, Artificial Sequence
  Description of Artificial Sequence: Synthetic oligonucleotide
uuagcauuuaucugaguuuuu

SEQ ID NO: 32036 - RNA, 21 nt, Artificial Sequence
  Description of Artificial Sequence: Synthetic oligonucleotide
uguagcauuuaucugaguuuu

SEQ ID NO: 32037 - RNA, 21 nt, Artificial Sequence
  Description of Artificial Sequence: Synthetic oligonucleotide
uaguagcauuuaucugaguuu

SEQ ID NO: 32038 - RNA, 21 nt, Artificial Sequence
  Description of Artificial Sequence: Synthetic oligonucleotide
ugaguagcauuuaucugaguu

SEQ ID NO: 32039 - RNA, 21 nt, Artificial Sequence
  Description of Artificial Sequence: Synthetic oligonucleotide
uugaguagcauuuaucugauu

SEQ ID NO: 32040 - RNA, 21 nt, Artificial Sequence
  Description of Artificial Sequence: Synthetic oligonucleotide
ucugaguagcauuuaucuguu

SEQ ID NO: 32041 - RNA, 21 nt, Artificial Sequence
  Description of Artificial Sequence: Synthetic oligonucleotide
uccugaguagcauuuaucuuu

SEQ ID NO: 32042 - RNA, 21 nt, Artificial Sequence
  Description of Artificial Sequence: Synthetic oligonucleotide
ugccugaguagcauuuaucuu

SEQ ID NO: 32043 - RNA, 21 nt, Artificial Sequence
  Description of Artificial Sequence: Synthetic oligonucleotide
uugccugaguagcauuuauuu

SEQ ID NO: 32044 - RNA, 21 nt, Artificial Sequence
  Description of Artificial Sequence: Synthetic oligonucleotide
uuugccugaguagcauuuauu

SEQ ID NO: 32045 - RNA, 21 nt, Artificial Sequence
  Description of Artificial Sequence: Synthetic oligonucleotide
uauugccugaguagcauuuuu

SEQ ID NO: 32046 - RNA, 21 nt, Artificial Sequence
  Description of Artificial Sequence: Synthetic oligonucleotide
ucauugccugaguagcauuuu

SEQ ID NO: 32047 - RNA, 21 nt, Artificial Sequence
  Description of Artificial Sequence: Synthetic oligonucleotide
uucauugccugaguagcauuu

SEQ ID NO: 32048 - RNA, 21 nt, Artificial Sequence
  Description of Artificial Sequence: Synthetic oligonucleotide
uuucauugccugaguagcauu

SEQ ID NO: 32049 - RNA, 21 nt, Artificial Sequence
  Description of Artificial Sequence: Synthetic oligonucleotide
ucuucauugccugaguagcuu

SEQ ID NO: 32050 - RNA, 21 nt, Artificial Sequence
  Description of Artificial Sequence: Synthetic oligonucleotide
uucuucauugccugaguaguu

SEQ ID NO: 32051 - RNA, 21 nt, Artificial Sequence
  Description of Artificial Sequence: Synthetic oligonucleotide
uuucuucauugccugaguauu

SEQ ID NO: 32052 - RNA, 21 nt, Artificial Sequence
  Description of Artificial Sequence: Synthetic oligonucleotide
ucuucuucauugccugaguuu

SEQ ID NO: 32053 - RNA, 21 nt, Artificial Sequence
  Description of Artificial Sequence: Synthetic oligonucleotide
uucuucuucauugccugaguu

SEQ ID NO: 32054 - RNA, 21 nt, Artificial Sequence
  Description of Artificial Sequence: Synthetic oligonucleotide
ucucuucuucauugccugauu

SEQ ID NO: 32055 - RNA, 21 nt, Artificial Sequence
  Description of Artificial Sequence: Synthetic oligonucleotide
uccucuucuucauugccuguu

SEQ ID NO: 32056 - RNA, 21 nt, Artificial Sequence
  Description of Artificial Sequence: Synthetic oligonucleotide
uuccucuucuucauugccuuu

SEQ ID NO: 32057 - RNA, 21 nt, Artificial Sequence
  Description of Artificial Sequence: Synthetic oligonucleotide
ucuccucuucuucauugccuu

SEQ ID NO: 32058 - RNA, 21 nt, Artificial Sequence
  Description of Artificial Sequence: Synthetic oligonucleotide
uucuccucuucuucauugcuu

SEQ ID NO: 32059 - RNA, 21 nt, Artificial Sequence
  Description of Artificial Sequence: Synthetic oligonucleotide
uuucuccucuucuucauuguu

SEQ ID NO: 32060 - RNA, 21 nt, Artificial Sequence
  Description of Artificial Sequence: Synthetic oligonucleotide
uuuucuccucuucuucauuuu

SEQ ID NO: 32061 - RNA, 21 nt, Artificial Sequence
  Description of Artificial Sequence: Synthetic oligonucleotide
uuuuucuccucuucuucauuu

SEQ ID NO: 32062 - RNA, 21 nt, Artificial Sequence
  Description of Artificial Sequence: Synthetic oligonucleotide
uuuuuucuccucuucuucauu

SEQ ID NO: 32063 - RNA, 21 nt, Artificial Sequence
  Description of Artificial Sequence: Synthetic oligonucleotide
ucuuuuucuccucuucuucuu

SEQ ID NO: 32064 - RNA, 21 nt, Artificial Sequence
  Description of Artificial Sequence: Synthetic oligonucleotide
uccuuuuucuccucuucuuuu

SEQ ID NO: 32065 - RNA, 21 nt, Artificial Sequence
  Description of Artificial Sequence: Synthetic oligonucleotide
uuccuuuuucuccucuucuuu

SEQ ID NO: 32066 - RNA, 21 nt, Artificial Sequence
  Description of Artificial Sequence: Synthetic oligonucleotide
uuuccuuuuucuccucuucuu

SEQ ID NO: 32067 - RNA, 21 nt, Artificial Sequence
  Description of Artificial Sequence: Synthetic oligonucleotide
uuuuccuuuuucuccucuuuu

SEQ ID NO: 32068 - RNA, 21 nt, Artificial Sequence
  Description of Artificial Sequence: Synthetic oligonucleotide
ucuuuccuuuuucuccucuuu

SEQ ID NO: 32069 - RNA, 21 nt, Artificial Sequence
  Description of Artificial Sequence: Synthetic oligonucleotide
uacuuuccuuuuucuccucuu

SEQ ID NO: 32070 - RNA, 21 nt, Artificial Sequence
  Description of Artificial Sequence: Synthetic oligonucleotide
ugacuuuccuuuuucuccuuu

SEQ ID NO: 32071 - RNA, 21 nt, Artificial Sequence
  Description of Artificial Sequence: Synthetic oligonucleotide
uugacuuuccuuuuucuccuu

SEQ ID NO: 32072 - RNA, 21 nt, Artificial Sequence
  Description of Artificial Sequence: Synthetic oligonucleotide
ugugacuuuccuuuuucucuu

SEQ ID NO: 32073 - RNA, 21 nt, Artificial Sequence
  Description of Artificial Sequence: Synthetic oligonucleotide
uugugacuuuccuuuuucuuu

SEQ ID NO: 32074 - RNA, 21 nt, Artificial Sequence
  Description of Artificial Sequence: Synthetic oligonucleotide
uuugugacuuuccuuuuucuu

SEQ ID NO: 32075 - RNA, 21 nt, Artificial Sequence
  Description of Artificial Sequence: Synthetic oligonucleotide
uguugugacuuuccuuuuuuu

SEQ ID NO: 32076 - RNA, 21 nt, Artificial Sequence
  Description of Artificial Sequence: Synthetic oligonucleotide
ugguugugacuuuccuuuuuu

SEQ ID NO: 32077 - RNA, 21 nt, Artificial Sequence
  Description of Artificial Sequence: Synthetic oligonucleotide
uugguugugacuuuccuuuuu

SEQ ID NO: 32078 - RNA, 21 nt, Artificial Sequence
  Description of Artificial Sequence: Synthetic oligonucleotide
uuugguugugacuuuccuuuu

SEQ ID NO: 32079 - RNA, 21 nt, Artificial Sequence
  Description of Artificial Sequence: Synthetic oligonucleotide
uauugguugugacuuuccuuu

SEQ ID NO: 32080 - RNA, 21 nt, Artificial Sequence
  Description of Artificial Sequence: Synthetic oligonucleotide
uuauugguugugacuuuccuu

SEQ ID NO: 32081 - RNA, 21 nt, Artificial Sequence
  Description of Artificial Sequence: Synthetic oligonucleotide
uuuauugguugugacuuucuu

SEQ ID NO: 32082 - RNA, 21 nt, Artificial Sequence
  Description of Artificial Sequence: Synthetic oligonucleotide
uuuuauugguugugacuuuuu

SEQ ID NO: 32083 - RNA, 21 nt, Artificial Sequence
  Description of Artificial Sequence: Synthetic oligonucleotide
uauuuauugguugugacuuuu

SEQ ID NO: 32084 - RNA, 21 nt, Artificial Sequence
  Description of Artificial Sequence: Synthetic oligonucleotide
ucauuuauugguugugacuuu

SEQ ID NO: 32085 - RNA, 21 nt, Artificial Sequence
  Description of Artificial Sequence: Synthetic oligonucleotide
uacauuuauugguugugacuu

SEQ ID NO: 32086 - RNA, 21 nt, Artificial Sequence
  Description of Artificial Sequence: Synthetic oligonucleotide
ugacauuuauugguugugauu

SEQ ID NO: 32087 - RNA, 21 nt, Artificial Sequence
  Description of Artificial Sequence: Synthetic oligonucleotide
uagacauuuauugguuguguu

SEQ ID NO: 32088 - RNA, 21 nt, Artificial Sequence
  Description of Artificial Sequence: Synthetic oligonucleotide
ucagacauuuauugguuguuu

SEQ ID NO: 32089 - RNA, 21 nt, Artificial Sequence
  Description of Artificial Sequence: Synthetic oligonucleotide
uccagacauuuauugguuguu

SEQ ID NO: 32090 - RNA, 21 nt, Artificial Sequence
  Description of Artificial Sequence: Synthetic oligonucleotide
uuccagacauuuauugguuuu

SEQ ID NO: 32091 - RNA, 21 nt, Artificial Sequence
  Description of Artificial Sequence: Synthetic oligonucleotide
uuuccagacauuuauugguuu

SEQ ID NO: 32092 - RNA, 21 nt, Artificial Sequence
  Description of Artificial Sequence: Synthetic oligonucleotide
uguuccagacauuuauugguu

SEQ ID NO: 32093 - RNA, 21 nt, Artificial Sequence
  Description of Artificial Sequence: Synthetic oligonucleotide
uuguuccagacauuuauuguu

SEQ ID NO: 32094 - RNA, 21 nt, Artificial Sequence
  Description of Artificial Sequence: Synthetic oligonucleotide
uuuguuccagacauuuauuuu

SEQ ID NO: 32095 - RNA, 21 nt, Artificial Sequence
  Description of Artificial Sequence: Synthetic oligonucleotide
ucuuguuccagacauuuauuu

SEQ ID NO: 32096 - RNA, 21 nt, Artificial Sequence
  Description of Artificial Sequence: Synthetic oligonucleotide
uacuuguuccagacauuuauu

SEQ ID NO: 32097 - RNA, 21 nt, Artificial Sequence
  Description of Artificial Sequence: Synthetic oligonucleotide
ucacuuguuccagacauuuuu

SEQ ID NO: 32098 - RNA, 21 nt, Artificial Sequence
  Description of Artificial Sequence: Synthetic oligonucleotide
uacacuuguuccagacauuuu

SEQ ID NO: 32099 - RNA, 21 nt, Artificial Sequence
  Description of Artificial Sequence: Synthetic oligonucleotide
ugacacuuguuccagacauuu

SEQ ID NO: 32100 - RNA, 21 nt, Artificial Sequence
  Description of Artificial Sequence: Synthetic oligonucleotide
uugacacuuguuccagacauu

SEQ ID NO: 32101 - RNA, 21 nt, Artificial Sequence
  Description of Artificial Sequence: Synthetic oligonucleotide
ugugacacuuguuccagacuu

SEQ ID NO: 32102 - RNA, 21 nt, Artificial Sequence
  Description of Artificial Sequence: Synthetic oligonucleotide
uugugacacuuguuccagauu

SEQ ID NO: 32103 - RNA, 21 nt, Artificial Sequence
  Description of Artificial Sequence: Synthetic oligonucleotide
uuugugacacuuguuccaguu

SEQ ID NO: 32104 - RNA, 21 nt, Artificial Sequence
  Description of Artificial Sequence: Synthetic oligonucleotide
uauugugacacuuguuccauu

SEQ ID NO: 32105 - RNA, 21 nt, Artificial Sequence
  Description of Artificial Sequence: Synthetic oligonucleotide
uaauugugacacuuguuccuu

SEQ ID NO: 32106 - RNA, 21 nt, Artificial Sequence
  Description of Artificial Sequence: Synthetic oligonucleotide
uuaauugugacacuuguucuu

SEQ ID NO: 32107 - RNA, 21 nt, Artificial Sequence
  Description of Artificial Sequence: Synthetic oligonucleotide
uguaauugugacacuuguuuu

SEQ ID NO: 32108 - RNA, 21 nt, Artificial Sequence
  Description of Artificial Sequence: Synthetic oligonucleotide
uuguaauugugacacuuguuu

SEQ ID NO: 32109 - RNA, 21 nt, Artificial Sequence
  Description of Artificial Sequence: Synthetic oligonucleotide
uuuguaauugugacacuuguu

SEQ ID NO: 32110 - RNA, 21 nt, Artificial Sequence
  Description of Artificial Sequence: Synthetic oligonucleotide
ucuuguaauugugacacuuuu

SEQ ID NO: 32111 - RNA, 21 nt, Artificial Sequence
  Description of Artificial Sequence: Synthetic oligonucleotide
uccuuguaauugugacacuuu

SEQ ID NO: 32112 - RNA, 21 nt, Artificial Sequence
  Description of Artificial Sequence: Synthetic oligonucleotide
uuccuuguaauugugacacuu

SEQ ID NO: 32113 - RNA, 21 nt, Artificial Sequence
  Description of Artificial Sequence: Synthetic oligonucleotide
uauccuuguaauugugacauu

SEQ ID NO: 32114 - RNA, 21 nt, Artificial Sequence
  Description of Artificial Sequence: Synthetic oligonucleotide
uaauccuuguaauugugacuu

SEQ ID NO: 32115 - RNA, 21 nt, Artificial Sequence
  Description of Artificial Sequence: Synthetic oligonucleotide
ucaauccuuguaauugugauu

SEQ ID NO: 32116 - RNA, 21 nt, Artificial Sequence
  Description of Artificial Sequence: Synthetic oligonucleotide
uacaauccuuguaauuguguu

SEQ ID NO: 32117 - RNA, 21 nt, Artificial Sequence
  Description of Artificial Sequence: Synthetic oligonucleotide
ucacaauccuuguaauuguuu

SEQ ID NO: 32118 - RNA, 21 nt, Artificial Sequence
  Description of Artificial Sequence: Synthetic oligonucleotide
uccacaauccuuguaauuguu

SEQ ID NO: 32119 - RNA, 21 nt, Artificial Sequence
  Description of Artificial Sequence: Synthetic oligonucleotide
ugccacaauccuuguaauuuu

SEQ ID NO: 32120 - RNA, 21 nt, Artificial Sequence
  Description of Artificial Sequence: Synthetic oligonucleotide
ucgccacaauccuuguaauuu

SEQ ID NO: 32121 - RNA, 21 nt, Artificial Sequence
  Description of Artificial Sequence: Synthetic oligonucleotide
uacgccacaauccuuguaauu

SEQ ID NO: 32122 - RNA, 21 nt, Artificial Sequence
  Description of Artificial Sequence: Synthetic oligonucleotide
ugacgccacaauccuuguauu

SEQ ID NO: 32123 - RNA, 21 nt, Artificial Sequence
  Description of Artificial Sequence: Synthetic oligonucleotide
ucgacgccacaauccuuguuu

SEQ ID NO: 32124 - RNA, 21 nt, Artificial Sequence
  Description of Artificial Sequence: Synthetic oligonucleotide
ugcgacgccacaauccuuguu

SEQ ID NO: 32125 - RNA, 21 nt, Artificial Sequence
  Description of Artificial Sequence: Synthetic oligonucleotide
uagcgacgccacaauccuuuu

SEQ ID NO: 32126 - RNA, 21 nt, Artificial Sequence
  Description of Artificial Sequence: Synthetic oligonucleotide
uaagcgacgccacaauccuuu

SEQ ID NO: 32127 - RNA, 21 nt, Artificial Sequence
  Description of Artificial Sequence: Synthetic oligonucleotide
ugaagcgacgccacaauccuu

SEQ ID NO: 32128 - RNA, 21 nt, Artificial Sequence
  Description of Artificial Sequence: Synthetic oligonucleotide
uugaagcgacgccacaaucuu

SEQ ID NO: 32129 - RNA, 21 nt, Artificial Sequence
  Description of Artificial Sequence: Synthetic oligonucleotide
uuugaagcgacgccacaauuu

SEQ ID NO: 32130 - RNA, 21 nt, Artificial Sequence
  Description of Artificial Sequence: Synthetic oligonucleotide
uauugaagcgacgccacaauu

SEQ ID NO: 32131 - RNA, 21 nt, Artificial Sequence
  Description of Artificial Sequence: Synthetic oligonucleotide
ugauugaagcgacgccacauu

SEQ ID NO: 32132 - RNA, 21 nt, Artificial Sequence
  Description of Artificial Sequence: Synthetic oligonucleotide
ucgauugaagcgacgccacuu

SEQ ID NO: 32133 - RNA, 21 nt, Artificial Sequence
  Description of Artificial Sequence: Synthetic oligonucleotide
uucgauugaagcgacgccauu

SEQ ID NO: 32134 - RNA, 21 nt, Artificial Sequence
  Description of Artificial Sequence: Synthetic oligonucleotide
ugucgauugaagcgacgccuu

SEQ ID NO: 32135 - RNA, 21 nt, Artificial Sequence
  Description of Artificial Sequence: Synthetic oligonucleotide
uggucgauugaagcgacgcuu

SEQ ID NO: 32136 - RNA, 21 nt, Artificial Sequence
  Description of Artificial Sequence: Synthetic oligonucleotide
uaggucgauugaagcgacguu

SEQ ID NO: 32137 - RNA, 21 nt, Artificial Sequence
  Description of Artificial Sequence: Synthetic oligonucleotide
uaaggucgauugaagcgacuu

SEQ ID NO: 32138 - RNA, 21 nt, Artificial Sequence
  Description of Artificial Sequence: Synthetic oligonucleotide
uaaaggucgauugaagcgauu

SEQ ID NO: 32139 - RNA, 21 nt, Artificial Sequence
  Description of Artificial Sequence: Synthetic oligonucleotide
uuaaaggucgauugaagcguu

SEQ ID NO: 32140 - RNA, 21 nt, Artificial Sequence
  Description of Artificial Sequence: Synthetic oligonucleotide
uguaaaggucgauugaagcuu

SEQ ID NO: 32141 - RNA, 21 nt, Artificial Sequence
  Description of Artificial Sequence: Synthetic oligonucleotide
uaguaaaggucgauugaaguu

SEQ ID NO: 32142 - RNA, 21 nt, Artificial Sequence
  Description of Artificial Sequence: Synthetic oligonucleotide
ucaguaaaggucgauugaauu

SEQ ID NO: 32143 - RNA, 21 nt, Artificial Sequence
  Description of Artificial Sequence: Synthetic oligonucleotide
uucaguaaaggucgauugauu

SEQ ID NO: 32144 - RNA, 21 nt, Artificial Sequence
  Description of Artificial Sequence: Synthetic oligonucleotide
uuucaguaaaggucgauuguu

SEQ ID NO: 32145 - RNA, 21 nt, Artificial Sequence
  Description of Artificial Sequence: Synthetic oligonucleotide
uuuucaguaaaggucgauuuu

SEQ ID NO: 32146 - RNA, 21 nt, Artificial Sequence
  Description of Artificial Sequence: Synthetic oligonucleotide
uguuucaguaaaggucgauuu

SEQ ID NO: 32147 - RNA, 21 nt, Artificial Sequence
  Description of Artificial Sequence: Synthetic oligonucleotide
uuguuucaguaaaggucgauu

SEQ ID NO: 32148 - RNA, 21 nt, Artificial Sequence
  Description of Artificial Sequence: Synthetic oligonucleotide
uuuguuucaguaaaggucguu

SEQ ID NO: 32149 - RNA, 21 nt, Artificial Sequence
  Description of Artificial Sequence: Synthetic oligonucleotide
uguuguuucaguaaaggucuu

SEQ ID NO: 32150 - RNA, 21 nt, Artificial Sequence
  Description of Artificial Sequence: Synthetic oligonucleotide
uuguuguuucaguaaagguuu

SEQ ID NO: 32151 - RNA, 21 nt, Artificial Sequence
  Description of Artificial Sequence: Synthetic oligonucleotide
ucuguuguuucaguaaagguu

SEQ ID NO: 32152 - RNA, 21 nt, Artificial Sequence
  Description of Artificial Sequence: Synthetic oligonucleotide
uacuguuguuucaguaaaguu

SEQ ID NO: 32153 - RNA, 21 nt, Artificial Sequence
  Description of Artificial Sequence: Synthetic oligonucleotide
uuacuguuguuucaguaaauu

SEQ ID NO: 32154 - RNA, 21 nt, Artificial Sequence
  Description of Artificial Sequence: Synthetic oligonucleotide
uuuacuguuguuucaguaauu

SEQ ID NO: 32155 - RNA, 21 nt, Artificial Sequence
  Description of Artificial Sequence: Synthetic oligonucleotide
uuuuacuguuguuucaguauu

SEQ ID NO: 32156 - RNA, 21 nt, Artificial Sequence
  Description of Artificial Sequence: Synthetic oligonucleotide
uguuuacuguuguuucaguuu

SEQ ID NO: 32157 - RNA, 21 nt, Artificial Sequence
  Description of Artificial Sequence: Synthetic oligonucleotide
ugguuuacuguuguuucaguu

SEQ ID NO: 32158 - RNA, 21 nt, Artificial Sequence
  Description of Artificial Sequence: Synthetic oligonucleotide
uugguuuacuguuguuucauu

SEQ ID NO: 32159 - RNA, 21 nt, Artificial Sequence
  Description of Artificial Sequence: Synthetic oligonucleotide
uaugguuuacuguuguuucuu

SEQ ID NO: 32160 - RNA, 21 nt, Artificial Sequence
  Description of Artificial Sequence: Synthetic oligonucleotide
ugaugguuuacuguuguuuuu

SEQ ID NO: 32161 - RNA, 21 nt, Artificial Sequence
  Description of Artificial Sequence: Synthetic oligonucleotide
uagaugguuuacuguuguuuu

SEQ ID NO: 32162 - RNA, 21 nt, Artificial Sequence
  Description of Artificial Sequence: Synthetic oligonucleotide
uaagaugguuuacuguuguuu

SEQ ID NO: 32163 - RNA, 21 nt, Artificial Sequence
  Description of Artificial Sequence: Synthetic oligonucleotide
uaaagaugguuuacuguuguu

SEQ ID NO: 32164 - RNA, 21 nt, Artificial Sequence
  Description of Artificial Sequence: Synthetic oligonucleotide
uuaaagaugguuuacuguuuu

SEQ ID NO: 32165 - RNA, 21 nt, Artificial Sequence
  Description of Artificial Sequence: Synthetic oligonucleotide
uauaaagaugguuuacuguuu

SEQ ID NO: 32166 - RNA, 21 nt, Artificial Sequence
  Description of Artificial Sequence: Synthetic oligonucleotide
uaauaaagaugguuuacuguu

SEQ ID NO: 32167 - RNA, 21 nt, Artificial Sequence
  Description of Artificial Sequence: Synthetic oligonucleotide
uuaauaaagaugguuuacuuu

SEQ ID NO: 32168 - RNA, 21 nt, Artificial Sequence
  Description of Artificial Sequence: Synthetic oligonucleotide
uauaauaaagaugguuuacuu

SEQ ID NO: 32169 - RNA, 21 nt, Artificial Sequence
  Description of Artificial Sequence: Synthetic oligonucleotide
ucauaauaaagaugguuuauu

SEQ ID NO: 32170 - RNA, 21 nt, Artificial Sequence
  Description of Artificial Sequence: Synthetic oligonucleotide
uccauaauaaagaugguuuuu

SEQ ID NO: 32171 - RNA, 21 nt, Artificial Sequence
  Description of Artificial Sequence: Synthetic oligonucleotide
uaccauaauaaagaugguuuu

SEQ ID NO: 32172 - RNA, 21 nt, Artificial Sequence
  Description of Artificial Sequence: Synthetic oligonucleotide
ugaccauaauaaagaugguuu

SEQ ID NO: 32173 - RNA, 21 nt, Artificial Sequence
  Description of Artificial Sequence: Synthetic oligonucleotide
uugaccauaauaaagaugguu

SEQ ID NO: 32174 - RNA, 21 nt, Artificial Sequence
  Description of Artificial Sequence: Synthetic oligonucleotide
uaugaccauaauaaagauguu

SEQ ID NO: 32175 - RNA, 21 nt, Artificial Sequence
  Description of Artificial Sequence: Synthetic oligonucleotide
uuaugaccauaauaaagauuu

SEQ ID NO: 32176 - RNA, 21 nt, Artificial Sequence
  Description of Artificial Sequence: Synthetic oligonucleotide
uauaugaccauaauaaagauu

SEQ ID NO: 32177 - RNA, 21 nt, Artificial Sequence
  Description of Artificial Sequence: Synthetic oligonucleotide
uaauaugaccauaauaaaguu

SEQ ID NO: 32178 - RNA, 21 nt, Artificial Sequence
  Description of Artificial Sequence: Synthetic oligonucleotide
uaaauaugaccauaauaaauu

SEQ ID NO: 32179 - RNA, 21 nt, Artificial Sequence
  Description of Artificial Sequence: Synthetic oligonucleotide
ugaaauaugaccauaauaauu

SEQ ID NO: 32180 - RNA, 21 nt, Artificial Sequence
  Description of Artificial Sequence: Synthetic oligonucleotide
uugaaauaugaccauaauauu

SEQ ID NO: 32181 - RNA, 21 nt, Artificial Sequence
  Description of Artificial Sequence: Synthetic oligonucleotide
ugugaaauaugaccauaauuu

SEQ ID NO: 32182 - RNA, 21 nt, Artificial Sequence
  Description of Artificial Sequence: Synthetic oligonucleotide
uugugaaauaugaccauaauu

SEQ ID NO: 32183 - RNA, 21 nt, Artificial Sequence
  Description of Artificial Sequence: Synthetic oligonucleotide
ucugugaaauaugaccauauu

SEQ ID NO: 32184 - RNA, 21 nt, Artificial Sequence
  Description of Artificial Sequence: Synthetic oligonucleotide
ugcugugaaauaugaccauuu

SEQ ID NO: 32185 - RNA, 21 nt, Artificial Sequence
  Description of Artificial Sequence: Synthetic oligonucleotide
uugcugugaaauaugaccauu

SEQ ID NO: 32186 - RNA, 21 nt, Artificial Sequence
  Description of Artificial Sequence: Synthetic oligonucleotide
ugugcugugaaauaugaccuu

SEQ ID NO: 32187 - RNA, 21 nt, Artificial Sequence
  Description of Artificial Sequence: Synthetic oligonucleotide
uggugcugugaaauaugacuu

SEQ ID NO: 32188 - RNA, 21 nt, Artificial Sequence
  Description of Artificial Sequence: Synthetic oligonucleotide
uuggugcugugaaauaugauu

SEQ ID NO: 32189 - RNA, 21 nt, Artificial Sequence
  Description of Artificial Sequence: Synthetic oligonucleotide
uuuggugcugugaaauauguu

SEQ ID NO: 32190 - RNA, 21 nt, Artificial Sequence
  Description of Artificial Sequence: Synthetic oligonucleotide
uuuuggugcugugaaauauuu

SEQ ID NO: 32191 - RNA, 21 nt, Artificial Sequence
  Description of Artificial Sequence: Synthetic oligonucleotide
uuuuuggugcugugaaauauu

SEQ ID NO: 32192 - RNA, 21 nt, Artificial Sequence
  Description of Artificial Sequence: Synthetic oligonucleotide
uauuuuggugcugugaaauuu

SEQ ID NO: 32193 - RNA, 21 nt, Artificial Sequence
  Description of Artificial Sequence: Synthetic oligonucleotide
uuauuuuggugcugugaaauu

SEQ ID NO: 32194 - RNA, 21 nt, Artificial Sequence
  Description of Artificial Sequence: Synthetic oligonucleotide
uuuauuuuggugcugugaauu

SEQ ID NO: 32195 - RNA, 21 nt, Artificial Sequence
  Description of Artificial Sequence: Synthetic oligonucleotide
uuuuauuuuggugcugugauu

SEQ ID NO: 32196 - RNA, 21 nt, Artificial Sequence
  Description of Artificial Sequence: Synthetic oligonucleotide
uauuuauuuuggugcuguguu

SEQ ID NO: 32197 - RNA, 21 nt, Artificial Sequence
  Description of Artificial Sequence: Synthetic oligonucleotide
ugauuuauuuuggugcuguuu

SEQ ID NO: 32198 - RNA, 21 nt, Artificial Sequence
  Description of Artificial Sequence: Synthetic oligonucleotide
uugauuuauuuuggugcuguu

SEQ ID NO: 32199 - RNA, 21 nt, Artificial Sequence
  Description of Artificial Sequence: Synthetic oligonucleotide
uaugauuuauuuuggugcuuu

SEQ ID NO: 32200 - RNA, 21 nt, Artificial Sequence
  Description of Artificial Sequence: Synthetic oligonucleotide
ugaugauuuauuuuggugcuu

SEQ ID NO: 32201 - RNA, 21 nt, Artificial Sequence
  Description of Artificial Sequence: Synthetic oligonucleotide
uagaugauuuauuuugguguu

SEQ ID NO: 32202 - RNA, 21 nt, Artificial Sequence
  Description of Artificial Sequence: Synthetic oligonucleotide
uaagaugauuuauuuugguuu

SEQ ID NO: 32203 - RNA, 21 nt, Artificial Sequence
  Description of Artificial Sequence: Synthetic oligonucleotide
uaaagaugauuuauuuugguu

SEQ ID NO: 32204 - RNA, 21 nt, Artificial Sequence
  Description of Artificial Sequence: Synthetic oligonucleotide
uuaaagaugauuuauuuuguu

SEQ ID NO: 32205 - RNA, 21 nt, Artificial Sequence
  Description of Artificial Sequence: Synthetic oligonucleotide
uauaaagaugauuuauuuuuu

SEQ ID NO: 32206 - RNA, 21 nt, Artificial Sequence
  Description of Artificial Sequence: Synthetic oligonucleotide
uaauaaagaugauuuauuuuu

SEQ ID NO: 32207 - RNA, 21 nt, Artificial Sequence
  Description of Artificial Sequence: Synthetic oligonucleotide
uuaauaaagaugauuuauuuu

SEQ ID NO: 32208 - RNA, 21 nt, Artificial Sequence
  Description of Artificial Sequence: Synthetic oligonucleotide
uuuaauaaagaugauuuauuu

SEQ ID NO: 32209 - RNA, 21 nt, Artificial Sequence
  Description of Artificial Sequence: Synthetic oligonucleotide
ucuuaauaaagaugauuuauu

SEQ ID NO: 32210 - RNA, 21 nt, Artificial Sequence
  Description of Artificial Sequence: Synthetic oligonucleotide
uacuuaauaaagaugauuuuu

SEQ ID NO: 32211 - RNA, 21 nt, Artificial Sequence
  Description of Artificial Sequence: Synthetic oligonucleotide
uuacuuaauaaagaugauuuu

SEQ ID NO: 32212 - RNA, 21 nt, Artificial Sequence
  Description of Artificial Sequence: Synthetic oligonucleotide
ucuacuuaauaaagaugauuu

SEQ ID NO: 32213 - RNA, 21 nt, Artificial Sequence
  Description of Artificial Sequence: Synthetic oligonucleotide
uucuacuuaauaaagaugauu

SEQ ID NO: 32214 - RNA, 21 nt, Artificial Sequence
  Description of Artificial Sequence: Synthetic oligonucleotide
uaucuacuuaauaaagauguu

SEQ ID NO: 32215 - RNA, 21 nt, Artificial Sequence
  Description of Artificial Sequence: Synthetic oligonucleotide
ucaucuacuuaauaaagauuu

SEQ ID NO: 32216 - RNA, 21 nt, Artificial Sequence
  Description of Artificial Sequence: Synthetic oligonucleotide
uucaucuacuuaauaaagauu

SEQ ID NO: 32217 - RNA, 21 nt, Artificial Sequence
  Description of Artificial Sequence: Synthetic oligonucleotide
uuucaucuacuuaauaaaguu

SEQ ID NO: 32218 - RNA, 21 nt, Artificial Sequence
  Description of Artificial Sequence: Synthetic oligonucleotide
uuuucaucuacuuaauaaauu

SEQ ID NO: 32219 - RNA, 21 nt, Artificial Sequence
  Description of Artificial Sequence: Synthetic oligonucleotide
uguuucaucuacuuaauaauu

SEQ ID NO: 32220 - RNA, 21 nt, Artificial Sequence
  Description of Artificial Sequence: Synthetic oligonucleotide
uuguuucaucuacuuaauauu

SEQ ID NO: 32221 - RNA, 21 nt, Artificial Sequence
  Description of Artificial Sequence: Synthetic oligonucleotide
uauguuucaucuacuuaauuu

SEQ ID NO: 32222 - RNA, 21 nt, Artificial Sequence
  Description of Artificial Sequence: Synthetic oligonucleotide
uaauguuucaucuacuuaauu

SEQ ID NO: 32223 - RNA, 21 nt, Artificial Sequence
  Description of Artificial Sequence: Synthetic oligonucleotide
uuaauguuucaucuacuuauu

SEQ ID NO: 32224 - RNA, 21 nt, Artificial Sequence
  Description of Artificial Sequence: Synthetic oligonucleotide
uuuaauguuucaucuacuuuu

SEQ ID NO: 32225 - RNA, 21 nt, Artificial Sequence
  Description of Artificial Sequence: Synthetic oligonucleotide
uguuaauguuucaucuacuuu

SEQ ID NO: 32226 - RNA, 21 nt, Artificial Sequence
  Description of Artificial Sequence: Synthetic oligonucleotide
uaguuaauguuucaucuacuu

SEQ ID NO: 32227 - RNA, 21 nt, Artificial Sequence
  Description of Artificial Sequence: Synthetic oligonucleotide
ugaguuaauguuucaucuauu

SEQ ID NO: 32228 - RNA, 21 nt, Artificial Sequence
  Description of Artificial Sequence: Synthetic oligonucleotide
uagaguuaauguuucaucuuu

SEQ ID NO: 32229 - RNA, 21 nt, Artificial Sequence
  Description of Artificial Sequence: Synthetic oligonucleotide
uuagaguuaauguuucaucuu

SEQ ID NO: 32230 - RNA, 21 nt, Artificial Sequence
  Description of Artificial Sequence: Synthetic oligonucleotide
uuuagaguuaauguuucauuu

SEQ ID NO: 32231 - RNA, 21 nt, Artificial Sequence
  Description of Artificial Sequence: Synthetic oligonucleotide
uguuagaguuaauguuucauu

SEQ ID NO: 32232 - RNA, 21 nt, Artificial Sequence
  Description of Artificial Sequence: Synthetic oligonucleotide
uaguuagaguuaauguuucuu

SEQ ID NO: 32233 - RNA, 21 nt, Artificial Sequence
  Description of Artificial Sequence: Synthetic oligonucleotide
ucaguuagaguuaauguuuuu

SEQ ID NO: 32234 - RNA, 21 nt, Artificial Sequence
  Description of Artificial Sequence: Synthetic oligonucleotide
uacaguuagaguuaauguuuu

SEQ ID NO: 32235 - RNA, 21 nt, Artificial Sequence
  Description of Artificial Sequence: Synthetic oligonucleotide
ucacaguuagaguuaauguuu

SEQ ID NO: 32236 - RNA, 21 nt, Artificial Sequence
  Description of Artificial Sequence: Synthetic oligonucleotide
uucacaguuagaguuaauguu

SEQ ID NO: 32237 - RNA, 21 nt, Artificial Sequence
  Description of Artificial Sequence: Synthetic oligonucleotide
ugucacaguuagaguuaauuu

SEQ ID NO: 32238 - RNA, 21 nt, Artificial Sequence
  Description of Artificial Sequence: Synthetic oligonucleotide
uugucacaguuagaguuaauu

SEQ ID NO: 32239 - RNA, 21 nt, Artificial Sequence
  Description of Artificial Sequence: Synthetic oligonucleotide
uuugucacaguuagaguuauu

SEQ ID NO: 32240 - RNA, 21 nt, Artificial Sequence
  Description of Artificial Sequence: Synthetic oligonucleotide
uuuugucacaguuagaguuuu

SEQ ID NO: 32241 - RNA, 21 nt, Artificial Sequence
  Description of Artificial Sequence: Synthetic oligonucleotide
ucuuugucacaguuagaguuu

SEQ ID NO: 32242 - RNA, 21 nt, Artificial Sequence
  Description of Artificial Sequence: Synthetic oligonucleotide
uucuuugucacaguuagaguu

SEQ ID NO: 32243 - RNA, 21 nt, Artificial Sequence
  Description of Artificial Sequence: Synthetic oligonucleotide
uuucuuugucacaguuagauu

SEQ ID NO: 32244 - RNA, 21 nt, Artificial Sequence
  Description of Artificial Sequence: Synthetic oligonucleotide
ucuucuuugucacaguuaguu

SEQ ID NO: 32245 - RNA, 21 nt, Artificial Sequence
  Description of Artificial Sequence: Synthetic oligonucleotide
uucuucuuugucacaguuauu

SEQ ID NO: 32246 - RNA, 21 nt, Artificial Sequence
  Description of Artificial Sequence: Synthetic oligonucleotide
ugucuucuuugucacaguuuu

SEQ ID NO: 32247 - RNA, 21 nt, Artificial Sequence
  Description of Artificial Sequence: Synthetic oligonucleotide
uggucuucuuugucacaguuu

SEQ ID NO: 32248 - RNA, 21 nt, Artificial Sequence
  Description of Artificial Sequence: Synthetic oligonucleotide
uuggucuucuuugucacaguu

SEQ ID NO: 32249 - RNA, 21 nt, Artificial Sequence
  Description of Artificial Sequence: Synthetic oligonucleotide
uguggucuucuuugucacauu

SEQ ID NO: 32250 - RNA, 21 nt, Artificial Sequence
  Description of Artificial Sequence: Synthetic oligonucleotide
uuguggucuucuuugucacuu

SEQ ID NO: 32251 - RNA, 21 nt, Artificial Sequence
  Description of Artificial Sequence: Synthetic oligonucleotide
uuuguggucuucuuugucauu

SEQ ID NO: 32252 - RNA, 21 nt, Artificial Sequence
  Description of Artificial Sequence: Synthetic oligonucleotide
uuuuguggucuucuuugucuu

SEQ ID NO: 32253 - RNA, 21 nt, Artificial Sequence
  Description of Artificial Sequence: Synthetic oligonucleotide
uauuuguggucuucuuuguuu

SEQ ID NO: 32254 - RNA, 21 nt, Artificial Sequence
  Description of Artificial Sequence: Synthetic oligonucleotide
uuauuuguggucuucuuuguu

SEQ ID NO: 32255 - RNA, 21 nt, Artificial Sequence
  Description of Artificial Sequence: Synthetic oligonucleotide
ucuauuuguggucuucuuuuu

SEQ ID NO: 32256 - RNA, 21 nt, Artificial Sequence
  Description of Artificial Sequence: Synthetic oligonucleotide
uacuauuuguggucuucuuuu

SEQ ID NO: 32257 - RNA, 21 nt, Artificial Sequence
  Description of Artificial Sequence: Synthetic oligonucleotide
uaacuauuuguggucuucuuu

SEQ ID NO: 32258 - RNA, 21 nt, Artificial Sequence
  Description of Artificial Sequence: Synthetic oligonucleotide
uuaacuauuuguggucuucuu

SEQ ID NO: 32259 - RNA, 21 nt, Artificial Sequence
  Description of Artificial Sequence: Synthetic oligonucleotide
uauaacuauuuguggucuuuu

SEQ ID NO: 32260 - RNA, 21 nt, Artificial Sequence
  Description of Artificial Sequence: Synthetic oligonucleotide
ugauaacuauuuguggucuuu

SEQ ID NO: 32261 - RNA, 21 nt, Artificial Sequence
  Description of Artificial Sequence: Synthetic oligonucleotide
uagauaacuauuuguggucuu

SEQ ID NO: 32262 - RNA, 21 nt, Artificial Sequence
  Description of Artificial Sequence: Synthetic oligonucleotide
uaagauaacuauuugugguuu

SEQ ID NO: 32263 - RNA, 21 nt, Artificial Sequence
  Description of Artificial Sequence: Synthetic oligonucleotide
uaaagauaacuauuugugguu

SEQ ID NO: 32264 - RNA, 21 nt, Artificial Sequence
  Description of Artificial Sequence: Synthetic oligonucleotide
uaaaagauaacuauuuguguu

SEQ ID NO: 32265 - RNA, 21 nt, Artificial Sequence
  Description of Artificial Sequence: Synthetic oligonucleotide
uuaaaagauaacuauuuguuu

SEQ ID NO: 32266 - RNA, 21 nt, Artificial Sequence
  Description of Artificial Sequence: Synthetic oligonucleotide
uuuaaaagauaacuauuuguu

SEQ ID NO: 32267 - RNA, 21 nt, Artificial Sequence
  Description of Artificial Sequence: Synthetic oligonucleotide
uauuaaaagauaacuauuuuu

SEQ ID NO: 32268 - RNA, 21 nt, Artificial Sequence
  Description of Artificial Sequence: Synthetic oligonucleotide
uaauuaaaagauaacuauuuu

SEQ ID NO: 32269 - RNA, 21 nt, Artificial Sequence
  Description of Artificial Sequence: Synthetic oligonucleotide
uuaauuaaaagauaacuauuu

SEQ ID NO: 32270 - RNA, 21 nt, Artificial Sequence
  Description of Artificial Sequence: Synthetic oligonucleotide
uguaauuaaaagauaacuauu

SEQ ID NO: 32271 - RNA, 21 nt, Artificial Sequence
  Description of Artificial Sequence: Synthetic oligonucleotide
uuguaauuaaaagauaacuuu

SEQ ID NO: 32272 - RNA, 21 nt, Artificial Sequence
  Description of Artificial Sequence: Synthetic oligonucleotide
ucuguaauuaaaagauaacuu

SEQ ID NO: 32273 - RNA, 21 nt, Artificial Sequence
  Description of Artificial Sequence: Synthetic oligonucleotide
uucuguaauuaaaagauaauu

SEQ ID NO: 32274 - RNA, 21 nt, Artificial Sequence
  Description of Artificial Sequence: Synthetic oligonucleotide
uuucuguaauuaaaagauauu

SEQ ID NO: 32275 - RNA, 21 nt, Artificial Sequence
  Description of Artificial Sequence: Synthetic oligonucleotide
ucuucuguaauuaaaagauuu

SEQ ID NO: 32276 - RNA, 21 nt, Artificial Sequence
  Description of Artificial Sequence: Synthetic oligonucleotide
uucuucuguaauuaaaagauu

SEQ ID NO: 32277 - RNA, 21 nt, Artificial Sequence
  Description of Artificial Sequence: Synthetic oligonucleotide
ucucuucuguaauuaaaaguu

SEQ ID NO: 32278 - RNA, 21 nt, Artificial Sequence
  Description of Artificial Sequence: Synthetic oligonucleotide
uacucuucuguaauuaaaauu

SEQ ID NO: 32279 - RNA, 21 nt, Artificial Sequence
  Description of Artificial Sequence: Synthetic oligonucleotide
uaacucuucuguaauuaaauu

SEQ ID NO: 32280 - RNA, 21 nt, Artificial Sequence
  Description of Artificial Sequence: Synthetic oligonucleotide
uaaacucuucuguaauuaauu

SEQ ID NO: 32281 - RNA, 21 nt, Artificial Sequence
  Description of Artificial Sequence: Synthetic oligonucleotide
ugaaacucuucuguaauuauu

SEQ ID NO: 32282 - RNA, 21 nt, Artificial Sequence
  Description of Artificial Sequence: Synthetic oligonucleotide
uagaaacucuucuguaauuuu

SEQ ID NO: 32283 - RNA, 21 nt, Artificial Sequence
  Description of Artificial Sequence: Synthetic oligonucleotide
uaagaaacucuucuguaauuu

SEQ ID NO: 32284 - RNA, 21 nt, Artificial Sequence
  Description of Artificial Sequence: Synthetic oligonucleotide
uuaagaaacucuucuguaauu

SEQ ID NO: 32285 - RNA, 21 nt, Artificial Sequence
  Description of Artificial Sequence: Synthetic oligonucleotide
uuuaagaaacucuucuguauu

SEQ ID NO: 32286 - RNA, 21 nt, Artificial Sequence
  Description of Artificial Sequence: Synthetic oligonucleotide
uguuaagaaacucuucuguuu

SEQ ID NO: 32287 - RNA, 21 nt, Artificial Sequence
  Description of Artificial Sequence: Synthetic oligonucleotide
uaguuaagaaacucuucuguu

SEQ ID NO: 32288 - RNA, 21 nt, Artificial Sequence
  Description of Artificial Sequence: Synthetic oligonucleotide
uaaguuaagaaacucuucuuu

SEQ ID NO: 32289 - RNA, 21 nt, Artificial Sequence
  Description of Artificial Sequence: Synthetic oligonucleotide
uuaaguuaagaaacucuucuu

SEQ ID NO: 32290 - RNA, 21 nt, Artificial Sequence
  Description of Artificial Sequence: Synthetic oligonucleotide
uguaaguuaagaaacucuuuu

SEQ ID NO: 32291 - RNA, 21 nt, Artificial Sequence
  Description of Artificial Sequence: Synthetic oligonucleotide
uaguaaguuaagaaacucuuu

SEQ ID NO: 32292 - RNA, 21 nt, Artificial Sequence
  Description of Artificial Sequence: Synthetic oligonucleotide
uaaguaaguuaagaaacucuu

SEQ ID NO: 32293 - RNA, 21 nt, Artificial Sequence
  Description of Artificial Sequence: Synthetic oligonucleotide
uaaaguaaguuaagaaacuuu

SEQ ID NO: 32294 - RNA, 21 nt, Artificial Sequence
  Description of Artificial Sequence: Synthetic oligonucleotide
uaaaaguaaguuaagaaacuu

SEQ ID NO: 32295 - RNA, 21 nt, Artificial Sequence
  Description of Artificial Sequence: Synthetic oligonucleotide
ucaaaaguaaguuaagaaauu

SEQ ID NO: 32296 - RNA, 21 nt, Artificial Sequence
  Description of Artificial Sequence: Synthetic oligonucleotide
uacaaaaguaaguuaagaauu

SEQ ID NO: 32297 - RNA, 21 nt, Artificial Sequence
  Description of Artificial Sequence: Synthetic oligonucleotide
uuacaaaaguaaguuaagauu

SEQ ID NO: 32298 - RNA, 21 nt, Artificial Sequence
  Description of Artificial Sequence: Synthetic oligonucleotide
uuuacaaaaguaaguuaaguu

SEQ ID NO: 32299 - RNA, 21 nt, Artificial Sequence
  Description of Artificial Sequence: Synthetic oligonucleotide
ucuuacaaaaguaaguuaauu

SEQ ID NO: 32300 - RNA, 21 nt, Artificial Sequence
  Description of Artificial Sequence: Synthetic oligonucleotide
uacuuacaaaaguaaguuauu

SEQ ID NO: 32301 - RNA, 21 nt, Artificial Sequence
  Description of Artificial Sequence: Synthetic oligonucleotide
uaacuuacaaaaguaaguuuu

SEQ ID NO: 32302 - RNA, 21 nt, Artificial Sequence
  Description of Artificial Sequence: Synthetic oligonucleotide
uaaacuuacaaaaguaaguuu

SEQ ID NO: 32303 - RNA, 21 nt, Artificial Sequence
  Description of Artificial Sequence: Synthetic oligonucleotide
uaaaacuuacaaaaguaaguu

SEQ ID NO: 32304 - RNA, 21 nt, Artificial Sequence
  Description of Artificial Sequence: Synthetic oligonucleotide
uaaaaacuuacaaaaguaauu

SEQ ID NO: 32305 - RNA, 21 nt, Artificial Sequence
  Description of Artificial Sequence: Synthetic oligonucleotide
uuaaaaacuuacaaaaguauu

SEQ ID NO: 32306 - RNA, 21 nt, Artificial Sequence
  Description of Artificial Sequence: Synthetic oligonucleotide
uauaaaaacuuacaaaaguuu

SEQ ID NO: 32307 - RNA, 21 nt, Artificial Sequence
  Description of Artificial Sequence: Synthetic oligonucleotide
uaauaaaaacuuacaaaaguu

SEQ ID NO: 32308 - RNA, 21 nt, Artificial Sequence
  Description of Artificial Sequence: Synthetic oligonucleotide
ucaauaaaaacuuacaaaauu

SEQ ID NO: 32309 - RNA, 21 nt, Artificial Sequence
  Description of Artificial Sequence: Synthetic oligonucleotide
uacaauaaaaacuuacaaauu

SEQ ID NO: 32310 - RNA, 21 nt, Artificial Sequence
  Description of Artificial Sequence: Synthetic oligonucleotide
ucacaauaaaaacuuacaauu

SEQ ID NO: 32311 - RNA, 21 nt, Artificial Sequence
  Description of Artificial Sequence: Synthetic oligonucleotide
uacacaauaaaaacuuacauu

SEQ ID NO: 32312 - RNA, 21 nt, Artificial Sequence
  Description of Artificial Sequence: Synthetic oligonucleotide
uuacacaauaaaaacuuacuu

SEQ ID NO: 32313 - RNA, 21 nt, Artificial Sequence
  Description of Artificial Sequence: Synthetic oligonucleotide
uuuacacaauaaaaacuuauu

SEQ ID NO: 32314 - RNA, 21 nt, Artificial Sequence
  Description of Artificial Sequence: Synthetic oligonucleotide
ucuuacacaauaaaaacuuuu

SEQ ID NO: 32315 - RNA, 21 nt, Artificial Sequence
  Description of Artificial Sequence: Synthetic oligonucleotide
uacuuacacaauaaaaacuuu

SEQ ID NO: 32316 - RNA, 21 nt, Artificial Sequence
  Description of Artificial Sequence: Synthetic oligonucleotide
uaacuuacacaauaaaaacuu

SEQ ID NO: 32317 - RNA, 21 nt, Artificial Sequence
  Description of Artificial Sequence: Synthetic oligonucleotide
uaaacuuacacaauaaaaauu

SEQ ID NO: 32318 - RNA, 21 nt, Artificial Sequence
  Description of Artificial Sequence: Synthetic oligonucleotide
uuaaacuuacacaauaaaauu

SEQ ID NO: 32319 - RNA, 21 nt, Artificial Sequence
  Description of Artificial Sequence: Synthetic oligonucleotide
uauaaacuuacacaauaaauu

SEQ ID NO: 32320 - RNA, 21 nt, Artificial Sequence
  Description of Artificial Sequence: Synthetic oligonucleotide
uuauaaacuuacacaauaauu

SEQ ID NO: 32321 - RNA, 21 nt, Artificial Sequence
  Description of Artificial Sequence: Synthetic oligonucleotide
uuuauaaacuuacacaauauu

SEQ ID NO: 32322 - RNA, 21 nt, Artificial Sequence
  Description of Artificial Sequence: Synthetic oligonucleotide
uauuauaaacuuacacaauuu

SEQ ID NO: 32323 - RNA, 21 nt, Artificial Sequence
  Description of Artificial Sequence: Synthetic oligonucleotide
ucauuauaaacuuacacaauu

SEQ ID NO: 32324 - RNA, 21 nt, Artificial Sequence
  Description of Artificial Sequence: Synthetic oligonucleotide
ugcauuauaaacuuacacauu

SEQ ID NO: 32325 - RNA, 21 nt, Artificial Sequence
  Description of Artificial Sequence: Synthetic oligonucleotide
uugcauuauaaacuuacacuu

SEQ ID NO: 32326 - RNA, 21 nt, Artificial Sequence
  Description of Artificial Sequence: Synthetic oligonucleotide
ucugcauuauaaacuuacauu

SEQ ID NO: 32327 - RNA, 21 nt, Artificial Sequence
  Description of Artificial Sequence: Synthetic oligonucleotide
uccugcauuauaaacuuacuu

SEQ ID NO: 32328 - RNA, 21 nt, Artificial Sequence
  Description of Artificial Sequence: Synthetic oligonucleotide
ucccugcauuauaaacuuauu

SEQ ID NO: 32329 - RNA, 21 nt, Artificial Sequence
  Description of Artificial Sequence: Synthetic oligonucleotide
uccccugcauuauaaacuuuu

SEQ ID NO: 32330 - RNA, 21 nt, Artificial Sequence
  Description of Artificial Sequence: Synthetic oligonucleotide
uuccccugcauuauaaacuuu

SEQ ID NO: 32331 - RNA, 21 nt, Artificial Sequence
  Description of Artificial Sequence: Synthetic oligonucleotide
uuuccccugcauuauaaacuu

SEQ ID NO: 32332 - RNA, 21 nt, Artificial Sequence
  Description of Artificial Sequence: Synthetic oligonucleotide
ucuuccccugcauuauaaauu

SEQ ID NO: 32333 - RNA, 21 nt, Artificial Sequence
  Description of Artificial Sequence: Synthetic oligonucleotide
uacuuccccugcauuauaauu

SEQ ID NO: 32334 - RNA, 21 nt, Artificial Sequence
  Description of Artificial Sequence: Synthetic oligonucleotide
uuacuuccccugcauuauauu

SEQ ID NO: 32335 - RNA, 21 nt, Artificial Sequence
  Description of Artificial Sequence: Synthetic oligonucleotide
uguacuuccccugcauuauuu

SEQ ID NO: 32336 - RNA, 21 nt, Artificial Sequence
  Description of Artificial Sequence: Synthetic oligonucleotide
uaguacuuccccugcauuauu

SEQ ID NO: 32337 - RNA, 21 nt, Artificial Sequence
  Description of Artificial Sequence: Synthetic oligonucleotide
uuaguacuuccccugcauuuu

SEQ ID NO: 32338 - RNA, 21 nt, Artificial Sequence
  Description of Artificial Sequence: Synthetic oligonucleotide
uguaguacuuccccugcauuu

SEQ ID NO: 32339 - RNA, 21 nt, Artificial Sequence
  Description of Artificial Sequence: Synthetic oligonucleotide
uaguaguacuuccccugcauu

SEQ ID NO: 32340 - RNA, 21 nt, Artificial Sequence
  Description of Artificial Sequence: Synthetic oligonucleotide
ugaguaguacuuccccugcuu

SEQ ID NO: 32341 - RNA, 21 nt, Artificial Sequence
  Description of Artificial Sequence: Synthetic oligonucleotide
uggaguaguacuuccccuguu

SEQ ID NO: 32342 - RNA, 21 nt, Artificial Sequence
  Description of Artificial Sequence: Synthetic oligonucleotide
uaggaguaguacuuccccuuu

SEQ ID NO: 32343 - RNA, 21 nt, Artificial Sequence
  Description of Artificial Sequence: Synthetic oligonucleotide
ugaggaguaguacuuccccuu

SEQ ID NO: 32344 - RNA, 21 nt, Artificial Sequence
  Description of Artificial Sequence: Synthetic oligonucleotide
uugaggaguaguacuucccuu

SEQ ID NO: 32345 - RNA, 21 nt, Artificial Sequence
  Description of Artificial Sequence: Synthetic oligonucleotide
uuugaggaguaguacuuccuu

SEQ ID NO: 32346 - RNA, 21 nt, Artificial Sequence
  Description of Artificial Sequence: Synthetic oligonucleotide
uuuugaggaguaguacuucuu

SEQ ID NO: 32347 - RNA, 21 nt, Artificial Sequence
  Description of Artificial Sequence: Synthetic oligonucleotide
uauuugaggaguaguacuuuu

SEQ ID NO: 32348 - RNA, 21 nt, Artificial Sequence
  Description of Artificial Sequence: Synthetic oligonucleotide
ucauuugaggaguaguacuuu

SEQ ID NO: 32349 - RNA, 21 nt, Artificial Sequence
  Description of Artificial Sequence: Synthetic oligonucleotide
uacauuugaggaguaguacuu

SEQ ID NO: 32350 - RNA, 21 nt, Artificial Sequence
  Description of Artificial Sequence: Synthetic oligonucleotide
uaacauuugaggaguaguauu

SEQ ID NO: 32351 - RNA, 21 nt, Artificial Sequence
  Description of Artificial Sequence: Synthetic oligonucleotide
ucaacauuugaggaguaguuu

SEQ ID NO: 32352 - RNA, 21 nt, Artificial Sequence
  Description of Artificial Sequence: Synthetic oligonucleotide
uucaacauuugaggaguaguu

SEQ ID NO: 32353 - RNA, 21 nt, Artificial Sequence
  Description of Artificial Sequence: Synthetic oligonucleotide
ucucaacauuugaggaguauu

SEQ ID NO: 32354 - RNA, 21 nt, Artificial Sequence
  Description of Artificial Sequence: Synthetic oligonucleotide
uccucaacauuugaggaguuu

SEQ ID NO: 32355 - RNA, 21 nt, Artificial Sequence
  Description of Artificial Sequence: Synthetic oligonucleotide
ucccucaacauuugaggaguu

SEQ ID NO: 32356 - RNA, 21 nt, Artificial Sequence
  Description of Artificial Sequence: Synthetic oligonucleotide
uucccucaacauuugaggauu

SEQ ID NO: 32357 - RNA, 21 nt, Artificial Sequence
  Description of Artificial Sequence: Synthetic oligonucleotide
uuucccucaacauuugagguu

SEQ ID NO: 32358 - RNA, 21 nt, Artificial Sequence
  Description of Artificial Sequence: Synthetic oligonucleotide
ucuucccucaacauuugaguu

SEQ ID NO: 32359 - RNA, 21 nt, Artificial Sequence
  Description of Artificial Sequence: Synthetic oligonucleotide
ugcuucccucaacauuugauu

SEQ ID NO: 32360 - RNA, 21 nt, Artificial Sequence
  Description of Artificial Sequence: Synthetic oligonucleotide
uagcuucccucaacauuuguu

SEQ ID NO: 32361 - RNA, 21 nt, Artificial Sequence
  Description of Artificial Sequence: Synthetic oligonucleotide
uaagcuucccucaacauuuuu

SEQ ID NO: 32362 - RNA, 21 nt, Artificial Sequence
  Description of Artificial Sequence: Synthetic oligonucleotide
ugaagcuucccucaacauuuu

SEQ ID NO: 32363 - RNA, 21 nt, Artificial Sequence
  Description of Artificial Sequence: Synthetic oligonucleotide
uggaagcuucccucaacauuu

SEQ ID NO: 32364 - RNA, 21 nt, Artificial Sequence
  Description of Artificial Sequence: Synthetic oligonucleotide
uuggaagcuucccucaacauu

SEQ ID NO: 32365 - RNA, 21 nt, Artificial Sequence
  Description of Artificial Sequence: Synthetic oligonucleotide
uauggaagcuucccucaacuu

SEQ ID NO: 32366 - RNA, 21 nt, Artificial Sequence
  Description of Artificial Sequence: Synthetic oligonucleotide
uuauggaagcuucccucaauu

SEQ ID NO: 32367 - RNA, 21 nt, Artificial Sequence
  Description of Artificial Sequence: Synthetic oligonucleotide
uuuauggaagcuucccucauu

SEQ ID NO: 32368 - RNA, 21 nt, Artificial Sequence
  Description of Artificial Sequence: Synthetic oligonucleotide
uguuauggaagcuucccucuu

SEQ ID NO: 32369 - RNA, 21 nt, Artificial Sequence
  Description of Artificial Sequence: Synthetic oligonucleotide
uuguuauggaagcuucccuuu

SEQ ID NO: 32370 - RNA, 21 nt, Artificial Sequence
  Description of Artificial Sequence: Synthetic oligonucleotide
uauguuauggaagcuucccuu

SEQ ID NO: 32371 - RNA, 21 nt, Artificial Sequence
  Description of Artificial Sequence: Synthetic oligonucleotide
uaauguuauggaagcuuccuu

SEQ ID NO: 32372 - RNA, 21 nt, Artificial Sequence
  Description of Artificial Sequence: Synthetic oligonucleotide
ucaauguuauggaagcuucuu

SEQ ID NO: 32373 - RNA, 21 nt, Artificial Sequence
  Description of Artificial Sequence: Synthetic oligonucleotide
uucaauguuauggaagcuuuu

SEQ ID NO: 32374 - RNA, 21 nt, Artificial Sequence
  Description of Artificial Sequence: Synthetic oligonucleotide
uaucaauguuauggaagcuuu

SEQ ID NO: 32375 - RNA, 21 nt, Artificial Sequence
  Description of Artificial Sequence: Synthetic oligonucleotide
ucaucaauguuauggaagcuu

SEQ ID NO: 32376 - RNA, 21 nt, Artificial Sequence
  Description of Artificial Sequence: Synthetic oligonucleotide
uucaucaauguuauggaaguu

SEQ ID NO: 32377 - RNA, 21 nt, Artificial Sequence
  Description of Artificial Sequence: Synthetic oligonucleotide
ugucaucaauguuauggaauu

SEQ ID NO: 32378 - RNA, 21 nt, Artificial Sequence
  Description of Artificial Sequence: Synthetic oligonucleotide
uagucaucaauguuauggauu

SEQ ID NO: 32379 - RNA, 21 nt, Artificial Sequence
  Description of Artificial Sequence: Synthetic oligonucleotide
ucagucaucaauguuaugguu

SEQ ID NO: 32380 - RNA, 21 nt, Artificial Sequence
  Description of Artificial Sequence: Synthetic oligonucleotide
uccagucaucaauguuauguu

SEQ ID NO: 32381 - RNA, 21 nt, Artificial Sequence
  Description of Artificial Sequence: Synthetic oligonucleotide
ugccagucaucaauguuauuu

SEQ ID NO: 32382 - RNA, 21 nt, Artificial Sequence
  Description of Artificial Sequence: Synthetic oligonucleotide
uagccagucaucaauguuauu

SEQ ID NO: 32383 - RNA, 21 nt, Artificial Sequence
  Description of Artificial Sequence: Synthetic oligonucleotide
uaagccagucaucaauguuuu

SEQ ID NO: 32384 - RNA, 21 nt, Artificial Sequence
  Description of Artificial Sequence: Synthetic oligonucleotide
ugaagccagucaucaauguuu

SEQ ID NO: 32385 - RNA, 21 nt, Artificial Sequence
  Description of Artificial Sequence: Synthetic oligonucleotide
uugaagccagucaucaauguu

SEQ ID NO: 32386 - RNA, 21 nt, Artificial Sequence
  Description of Artificial Sequence: Synthetic oligonucleotide
uaugaagccagucaucaauuu

SEQ ID NO: 32387 - RNA, 21 nt, Artificial Sequence
  Description of Artificial Sequence: Synthetic oligonucleotide
ucaugaagccagucaucaauu

SEQ ID NO: 32388 - RNA, 21 nt, Artificial Sequence
  Description of Artificial Sequence: Synthetic oligonucleotide
uccaugaagccagucaucauu

SEQ ID NO: 32389 - RNA, 21 nt, Artificial Sequence
  Description of Artificial Sequence: Synthetic oligonucleotide
ugccaugaagccagucaucuu

SEQ ID NO: 32390 - RNA, 21 nt, Artificial Sequence
  Description of Artificial Sequence: Synthetic oligonucleotide
uugccaugaagccagucauuu

SEQ ID NO: 32391 - RNA, 21 nt, Artificial Sequence
  Description of Artificial Sequence: Synthetic oligonucleotide
ucugccaugaagccagucauu

SEQ ID NO: 32392 - RNA, 21 nt, Artificial Sequence
  Description of Artificial Sequence: Synthetic oligonucleotide
uacugccaugaagccagucuu

SEQ ID NO: 32393 - RNA, 21 nt, Artificial Sequence
  Description of Artificial Sequence: Synthetic oligonucleotide
uuacugccaugaagccaguuu

SEQ ID NO: 32394 - RNA, 21 nt, Artificial Sequence
  Description of Artificial Sequence: Synthetic oligonucleotide
uuuacugccaugaagccaguu

SEQ ID NO: 32395 - RNA, 21 nt, Artificial Sequence
  Description of Artificial Sequence: Synthetic oligonucleotide
uauuacugccaugaagccauu

SEQ ID NO: 32396 - RNA, 21 nt, Artificial Sequence
  Description of Artificial Sequence: Synthetic oligonucleotide
uaauuacugccaugaagccuu

SEQ ID NO: 32397 - RNA, 21 nt, Artificial Sequence
  Description of Artificial Sequence: Synthetic oligonucleotide
ugaauuacugccaugaagcuu

SEQ ID NO: 32398 - RNA, 21 nt, Artificial Sequence
  Description of Artificial Sequence: Synthetic oligonucleotide
uagaauuacugccaugaaguu

SEQ ID NO: 32399 - RNA, 21 nt, Artificial Sequence
  Description of Artificial Sequence: Synthetic oligonucleotide
ugagaauuacugccaugaauu

SEQ ID NO: 32400 - RNA, 21 nt, Artificial Sequence
  Description of Artificial Sequence: Synthetic oligonucleotide
ucgagaauuacugccaugauu

SEQ ID NO: 32401 - RNA, 21 nt, Artificial Sequence
  Description of Artificial Sequence: Synthetic oligonucleotide
uccgagaauuacugccauguu

SEQ ID NO: 32402 - RNA, 21 nt, Artificial Sequence
  Description of Artificial Sequence: Synthetic oligonucleotide
ugccgagaauuacugccauuu

SEQ ID NO: 32403 - RNA, 21 nt, Artificial Sequence
  Description of Artificial Sequence: Synthetic oligonucleotide
uagccgagaauuacugccauu

SEQ ID NO: 32404 - RNA, 21 nt, Artificial Sequence
  Description of Artificial Sequence: Synthetic oligonucleotide
ucagccgagaauuacugccuu

SEQ ID NO: 32405 - RNA, 21 nt, Artificial Sequence
  Description of Artificial Sequence: Synthetic oligonucleotide
uacagccgagaauuacugcuu

SEQ ID NO: 32406 - RNA, 21 nt, Artificial Sequence
  Description of Artificial Sequence: Synthetic oligonucleotide
uuacagccgagaauuacuguu

SEQ ID NO: 32407 - RNA, 21 nt, Artificial Sequence
  Description of Artificial Sequence: Synthetic oligonucleotide
ucuacagccgagaauuacuuu

SEQ ID NO: 32408 - RNA, 21 nt, Artificial Sequence
  Description of Artificial Sequence: Synthetic oligonucleotide
uacuacagccgagaauuacuu

SEQ ID NO: 32409 - RNA, 21 nt, Artificial Sequence
  Description of Artificial Sequence: Synthetic oligonucleotide
uaacuacagccgagaauuauu

SEQ ID NO: 32410 - RNA, 21 nt, Artificial Sequence
  Description of Artificial Sequence: Synthetic oligonucleotide
ucaacuacagccgagaauuuu

SEQ ID NO: 32411 - RNA, 21 nt, Artificial Sequence
  Description of Artificial Sequence: Synthetic oligonucleotide
ugcaacuacagccgagaauuu

SEQ ID NO: 32412 - RNA, 21 nt, Artificial Sequence
  Description of Artificial Sequence: Synthetic oligonucleotide
uugcaacuacagccgagaauu

SEQ ID NO: 32413 - RNA, 21 nt, Artificial Sequence
  Description of Artificial Sequence: Synthetic oligonucleotide
uaugcaacuacagccgagauu

SEQ ID NO: 32414 - RNA, 21 nt, Artificial Sequence
  Description of Artificial Sequence: Synthetic oligonucleotide
uuaugcaacuacagccgaguu

SEQ ID NO: 32415 - RNA, 21 nt, Artificial Sequence
  Description of Artificial Sequence: Synthetic oligonucleotide
uuuaugcaacuacagccgauu

SEQ ID NO: 32416 - RNA, 21 nt, Artificial Sequence
  Description of Artificial Sequence: Synthetic oligonucleotide
ucuuaugcaacuacagccguu

SEQ ID NO: 32417 - RNA, 21 nt, Artificial Sequence
  Description of Artificial Sequence: Synthetic oligonucleotide
ugcuuaugcaacuacagccuu

SEQ ID NO: 32418 - RNA, 21 nt, Artificial Sequence
  Description of Artificial Sequence: Synthetic oligonucleotide
uugcuuaugcaacuacagcuu

SEQ ID NO: 32419 - RNA, 21 nt, Artificial Sequence
  Description of Artificial Sequence: Synthetic oligonucleotide
uaugcuuaugcaacuacaguu

SEQ ID NO: 32420 - RNA, 21 nt, Artificial Sequence
  Description of Artificial Sequence: Synthetic oligonucleotide
uaaugcuuaugcaacuacauu

SEQ ID NO: 32421 - RNA, 21 nt, Artificial Sequence
  Description of Artificial Sequence: Synthetic oligonucleotide
ucaaugcuuaugcaacuacuu

SEQ ID NO: 32422 - RNA, 21 nt, Artificial Sequence
  Description of Artificial Sequence: Synthetic oligonucleotide
ugcaaugcuuaugcaacuauu

SEQ ID NO: 32423 - RNA, 21 nt, Artificial Sequence
  Description of Artificial Sequence: Synthetic oligonucleotide
uagcaaugcuuaugcaacuuu

SEQ ID NO: 32424 - RNA, 21 nt, Artificial Sequence
  Description of Artificial Sequence: Synthetic oligonucleotide
ugagcaaugcuuaugcaacuu

SEQ ID NO: 32425 - RNA, 21 nt, Artificial Sequence
  Description of Artificial Sequence: Synthetic oligonucleotide
uugagcaaugcuuaugcaauu

SEQ ID NO: 32426 - RNA, 21 nt, Artificial Sequence
  Description of Artificial Sequence: Synthetic oligonucleotide
uuugagcaaugcuuaugcauu

SEQ ID NO: 32427 - RNA, 21 nt, Artificial Sequence
  Description of Artificial Sequence: Synthetic oligonucleotide
ucuugagcaaugcuuaugcuu

SEQ ID NO: 32428 - RNA, 21 nt, Artificial Sequence
  Description of Artificial Sequence: Synthetic oligonucleotide
uucuugagcaaugcuuauguu

SEQ ID NO: 32429 - RNA, 21 nt, Artificial Sequence
  Description of Artificial Sequence: Synthetic oligonucleotide
ucucuugagcaaugcuuauuu

SEQ ID NO: 32430 - RNA, 21 nt, Artificial Sequence
  Description of Artificial Sequence: Synthetic oligonucleotide
uccucuugagcaaugcuuauu

SEQ ID NO: 32431 - RNA, 21 nt, Artificial Sequence
  Description of Artificial Sequence: Synthetic oligonucleotide
uuccucuugagcaaugcuuuu

SEQ ID NO: 32432 - RNA, 21 nt, Artificial Sequence
  Description of Artificial Sequence: Synthetic oligonucleotide
uuuccucuugagcaaugcuuu

SEQ ID NO: 32433 - RNA, 21 nt, Artificial Sequence
  Description of Artificial Sequence: Synthetic oligonucleotide
uuuuccucuugagcaaugcuu

SEQ ID NO: 32434 - RNA, 21 nt, Artificial Sequence
  Description of Artificial Sequence: Synthetic oligonucleotide
uuuuuccucuugagcaauguu

SEQ ID NO: 32435 - RNA, 21 nt, Artificial Sequence
  Description of Artificial Sequence: Synthetic oligonucleotide
uauuuuccucuugagcaauuu

SEQ ID NO: 32436 - RNA, 21 nt, Artificial Sequence
  Description of Artificial Sequence: Synthetic oligonucleotide
ugauuuuccucuugagcaauu

SEQ ID NO: 32437 - RNA, 21 nt, Artificial Sequence
  Description of Artificial Sequence: Synthetic oligonucleotide
uggauuuuccucuugagcauu

SEQ ID NO: 32438 - RNA, 21 nt, Artificial Sequence
  Description of Artificial Sequence: Synthetic oligonucleotide
uuggauuuuccucuugagcuu

SEQ ID NO: 32439 - RNA, 21 nt, Artificial Sequence
  Description of Artificial Sequence: Synthetic oligonucleotide
uuuggauuuuccucuugaguu

SEQ ID NO: 32440 - RNA, 21 nt, Artificial Sequence
  Description of Artificial Sequence: Synthetic oligonucleotide
uuuuggauuuuccucuugauu

SEQ ID NO: 32441 - RNA, 21 nt, Artificial Sequence
  Description of Artificial Sequence: Synthetic oligonucleotide
uuuuuggauuuuccucuuguu

SEQ ID NO: 32442 - RNA, 21 nt, Artificial Sequence
  Description of Artificial Sequence: Synthetic oligonucleotide
ucuuuuggauuuuccucuuuu

SEQ ID NO: 32443 - RNA, 21 nt, Artificial Sequence
  Description of Artificial Sequence: Synthetic oligonucleotide
uacuuuuggauuuuccucuuu

SEQ ID NO: 32444 - RNA, 21 nt, Artificial Sequence
  Description of Artificial Sequence: Synthetic oligonucleotide
ucacuuuuggauuuuccucuu

SEQ ID NO: 32445 - RNA, 21 nt, Artificial Sequence
  Description of Artificial Sequence: Synthetic oligonucleotide
ugcacuuuuggauuuuccuuu

SEQ ID NO: 32446 - RNA, 21 nt, Artificial Sequence
  Description of Artificial Sequence: Synthetic oligonucleotide
uugcacuuuuggauuuuccuu

SEQ ID NO: 32447 - RNA, 21 nt, Artificial Sequence
  Description of Artificial Sequence: Synthetic oligonucleotide
ucugcacuuuuggauuuucuu

SEQ ID NO: 32448 - RNA, 21 nt, Artificial Sequence
  Description of Artificial Sequence: Synthetic oligonucleotide
ugcugcacuuuuggauuuuuu

SEQ ID NO: 32449 - RNA, 21 nt, Artificial Sequence
  Description of Artificial Sequence: Synthetic oligonucleotide
uugcugcacuuuuggauuuuu

SEQ ID NO: 32450 - RNA, 21 nt, Artificial Sequence
  Description of Artificial Sequence: Synthetic oligonucleotide
ucugcugcacuuuuggauuuu

SEQ ID NO: 32451 - RNA, 21 nt, Artificial Sequence
  Description of Artificial Sequence: Synthetic oligonucleotide
uccugcugcacuuuuggauuu

SEQ ID NO: 32452 - RNA, 21 nt, Artificial Sequence
  Description of Artificial Sequence: Synthetic oligonucleotide
uuccugcugcacuuuuggauu

SEQ ID NO: 32453 - RNA, 21 nt, Artificial Sequence
  Description of Artificial Sequence: Synthetic oligonucleotide
ucuccugcugcacuuuugguu

SEQ ID NO: 32454 - RNA, 21 nt, Artificial Sequence
  Description of Artificial Sequence: Synthetic oligonucleotide
uucuccugcugcacuuuuguu

SEQ ID NO: 32455 - RNA, 21 nt, Artificial Sequence
  Description of Artificial Sequence: Synthetic oligonucleotide
uuucuccugcugcacuuuuuu

SEQ ID NO: 32456 - RNA, 21 nt, Artificial Sequence
  Description of Artificial Sequence: Synthetic oligonucleotide
uguucuccugcugcacuuuuu

SEQ ID NO: 32457 - RNA, 21 nt, Artificial Sequence
  Description of Artificial Sequence: Synthetic oligonucleotide
uaguucuccugcugcacuuuu

SEQ ID NO: 32458 - RNA, 21 nt, Artificial Sequence
  Description of Artificial Sequence: Synthetic oligonucleotide
ugaguucuccugcugcacuuu

SEQ ID NO: 32459 - RNA, 21 nt, Artificial Sequence
  Description of Artificial Sequence: Synthetic oligonucleotide
uagaguucuccugcugcacuu

SEQ ID NO: 32460 - RNA, 21 nt, Artificial Sequence
  Description of Artificial Sequence: Synthetic oligonucleotide
uaagaguucuccugcugcauu

SEQ ID NO: 32461 - RNA, 21 nt, Artificial Sequence
  Description of Artificial Sequence: Synthetic oligonucleotide
uaaagaguucuccugcugcuu

SEQ ID NO: 32462 - RNA, 21 nt, Artificial Sequence
  Description of Artificial Sequence: Synthetic oligonucleotide
uaaaagaguucuccugcuguu

SEQ ID NO: 32463 - RNA, 21 nt, Artificial Sequence
  Description of Artificial Sequence: Synthetic oligonucleotide
ugaaaagaguucuccugcuuu

SEQ ID NO: 32464 - RNA, 21 nt, Artificial Sequence
  Description of Artificial Sequence: Synthetic oligonucleotide
uggaaaagaguucuccugcuu

SEQ ID NO: 32465 - RNA, 21 nt, Artificial Sequence
  Description of Artificial Sequence: Synthetic oligonucleotide
ugggaaaagaguucuccuguu

SEQ ID NO: 32466 - RNA, 21 nt, Artificial Sequence
  Description of Artificial Sequence: Synthetic oligonucleotide
uagggaaaagaguucuccuuu

SEQ ID NO: 32467 - RNA, 21 nt, Artificial Sequence
  Description of Artificial Sequence: Synthetic oligonucleotide
ucagggaaaagaguucuccuu

SEQ ID NO: 32468 - RNA, 21 nt, Artificial Sequence
  Description of Artificial Sequence: Synthetic oligonucleotide
uucagggaaaagaguucucuu

SEQ ID NO: 32469 - RNA, 21 nt, Artificial Sequence
  Description of Artificial Sequence: Synthetic oligonucleotide
uuucagggaaaagaguucuuu

SEQ ID NO: 32470 - RNA, 21 nt, Artificial Sequence
  Description of Artificial Sequence: Synthetic oligonucleotide
uuuucagggaaaagaguucuu

SEQ ID NO: 32471 - RNA, 21 nt, Artificial Sequence
  Description of Artificial Sequence: Synthetic oligonucleotide
uuuuucagggaaaagaguuuu

SEQ ID NO: 32472 - RNA, 21 nt, Artificial Sequence
  Description of Artificial Sequence: Synthetic oligonucleotide
uuuuuucagggaaaagaguuu

SEQ ID NO: 32473 - RNA, 21 nt, Artificial Sequence
  Description of Artificial Sequence: Synthetic oligonucleotide
ucuuuuucagggaaaagaguu

SEQ ID NO: 32474 - RNA, 21 nt, Artificial Sequence
  Description of Artificial Sequence: Synthetic oligonucleotide
uccuuuuucagggaaaagauu

SEQ ID NO: 32475 - RNA, 21 nt, Artificial Sequence
  Description of Artificial Sequence: Synthetic oligonucleotide
uuccuuuuucagggaaaaguu

SEQ ID NO: 32476 - RNA, 21 nt, Artificial Sequence
  Description of Artificial Sequence: Synthetic oligonucleotide
uuuccuuuuucagggaaaauu

SEQ ID NO: 32477 - RNA, 21 nt, Artificial Sequence
  Description of Artificial Sequence: Synthetic oligonucleotide
uuuuccuuuuucagggaaauu

SEQ ID NO: 32478 - RNA, 21 nt, Artificial Sequence
  Description of Artificial Sequence: Synthetic oligonucleotide
uuuuuccuuuuucagggaauu

SEQ ID NO: 32479 - RNA, 21 nt, Artificial Sequence
  Description of Artificial Sequence: Synthetic oligonucleotide
uuuuuuccuuuuucagggauu

SEQ ID NO: 32480 - RNA, 21 nt, Artificial Sequence
  Description of Artificial Sequence: Synthetic oligonucleotide
uauuuuuccuuuuucaggguu

SEQ ID NO: 32481 - RNA, 21 nt, Artificial Sequence
  Description of Artificial Sequence: Synthetic oligonucleotide
uuauuuuuccuuuuucagguu

SEQ ID NO: 32482 - RNA, 21 nt, Artificial Sequence
  Description of Artificial Sequence: Synthetic oligonucleotide
uauauuuuuccuuuuucaguu

SEQ ID NO: 32483 - RNA, 21 nt, Artificial Sequence
  Description of Artificial Sequence: Synthetic oligonucleotide
uaauauuuuuccuuuuucauu

SEQ ID NO: 32484 - RNA, 21 nt, Artificial Sequence
  Description of Artificial Sequence: Synthetic oligonucleotide
ucaauauuuuuccuuuuucuu

SEQ ID NO: 32485 - RNA, 21 nt, Artificial Sequence
  Description of Artificial Sequence: Synthetic oligonucleotide
uucaauauuuuuccuuuuuuu

SEQ ID NO: 32486 - RNA, 21 nt, Artificial Sequence
  Description of Artificial Sequence: Synthetic oligonucleotide
uuucaauauuuuuccuuuuuu

SEQ ID NO: 32487 - RNA, 21 nt, Artificial Sequence
  Description of Artificial Sequence: Synthetic oligonucleotide
uguucaauauuuuuccuuuuu

SEQ ID NO: 32488 - RNA, 21 nt, Artificial Sequence
  Description of Artificial Sequence: Synthetic oligonucleotide
uaguucaauauuuuuccuuuu

SEQ ID NO: 32489 - RNA, 21 nt, Artificial Sequence
  Description of Artificial Sequence: Synthetic oligonucleotide
ugaguucaauauuuuuccuuu

SEQ ID NO: 32490 - RNA, 21 nt, Artificial Sequence
  Description of Artificial Sequence: Synthetic oligonucleotide
uugaguucaauauuuuuccuu

SEQ ID NO: 32491 - RNA, 21 nt, Artificial Sequence
  Description of Artificial Sequence: Synthetic oligonucleotide
uuugaguucaauauuuuucuu

SEQ ID NO: 32492 - RNA, 21 nt, Artificial Sequence
  Description of Artificial Sequence: Synthetic oligonucleotide
uauugaguucaauauuuuuuu

SEQ ID NO: 32493 - RNA, 21 nt, Artificial Sequence
  Description of Artificial Sequence: Synthetic oligonucleotide
ucauugaguucaauauuuuuu

SEQ ID NO: 32494 - RNA, 21 nt, Artificial Sequence
  Description of Artificial Sequence: Synthetic oligonucleotide
uucauugaguucaauauuuuu

SEQ ID NO: 32495 - RNA, 21 nt, Artificial Sequence
  Description of Artificial Sequence: Synthetic oligonucleotide
uaucauugaguucaauauuuu

SEQ ID NO: 32496 - RNA, 21 nt, Artificial Sequence
  Description of Artificial Sequence: Synthetic oligonucleotide
uuaucauugaguucaauauuu

SEQ ID NO: 32497 - RNA, 21 nt, Artificial Sequence
  Description of Artificial Sequence: Synthetic oligonucleotide
ucuaucauugaguucaauauu

SEQ ID NO: 32498 - RNA, 21 nt, Artificial Sequence
  Description of Artificial Sequence: Synthetic oligonucleotide
ugcuaucauugaguucaauuu

SEQ ID NO: 32499 - RNA, 21 nt, Artificial Sequence
  Description of Artificial Sequence: Synthetic oligonucleotide
uugcuaucauugaguucaauu

SEQ ID NO: 32500 - RNA, 21 nt, Artificial Sequence
  Description of Artificial Sequence: Synthetic oligonucleotide
ugugcuaucauugaguucauu

SEQ ID NO: 32501 - RNA, 21 nt, Artificial Sequence
  Description of Artificial Sequence: Synthetic oligonucleotide
uggugcuaucauugaguucuu

SEQ ID NO: 32502 - RNA, 21 nt, Artificial Sequence
  Description of Artificial Sequence: Synthetic oligonucleotide
uaggugcuaucauugaguuuu

SEQ ID NO: 32503 - RNA, 21 nt, Artificial Sequence
  Description of Artificial Sequence: Synthetic oligonucleotide
uuaggugcuaucauugaguuu

SEQ ID NO: 32504 - RNA, 21 nt, Artificial Sequence
  Description of Artificial Sequence: Synthetic oligonucleotide
uuuaggugcuaucauugaguu

SEQ ID NO: 32505 - RNA, 21 nt, Artificial Sequence
  Description of Artificial Sequence: Synthetic oligonucleotide
uuuuaggugcuaucauugauu

SEQ ID NO: 32506 - RNA, 21 nt, Artificial Sequence
  Description of Artificial Sequence: Synthetic oligonucleotide
uguuuaggugcuaucauuguu

SEQ ID NO: 32507 - RNA, 21 nt, Artificial Sequence
  Description of Artificial Sequence: Synthetic oligonucleotide
uaguuuaggugcuaucauuuu

SEQ ID NO: 32508 - RNA, 21 nt, Artificial Sequence
  Description of Artificial Sequence: Synthetic oligonucleotide
uaaguuuaggugcuaucauuu

SEQ ID NO: 32509 - RNA, 21 nt, Artificial Sequence
  Description of Artificial Sequence: Synthetic oligonucleotide
uuaaguuuaggugcuaucauu

SEQ ID NO: 32510 - RNA, 21 nt, Artificial Sequence
  Description of Artificial Sequence: Synthetic oligonucleotide
uguaaguuuaggugcuaucuu

SEQ ID NO: 32511 - RNA, 21 nt, Artificial Sequence
  Description of Artificial Sequence: Synthetic oligonucleotide
uuguaaguuuaggugcuauuu

SEQ ID NO: 32512 - RNA, 21 nt, Artificial Sequence
  Description of Artificial Sequence: Synthetic oligonucleotide
uauguaaguuuaggugcuauu

SEQ ID NO: 32513 - RNA, 21 nt, Artificial Sequence
  Description of Artificial Sequence: Synthetic oligonucleotide
uaauguaaguuuaggugcuuu

SEQ ID NO: 32514 - RNA, 21 nt, Artificial Sequence
  Description of Artificial Sequence: Synthetic oligonucleotide
uaaauguaaguuuaggugcuu

SEQ ID NO: 32515 - RNA, 21 nt, Artificial Sequence
  Description of Artificial Sequence: Synthetic oligonucleotide
uuaaauguaaguuuagguguu

SEQ ID NO: 32516 - RNA, 21 nt, Artificial Sequence
  Description of Artificial Sequence: Synthetic oligonucleotide
uuuaaauguaaguuuagguuu

SEQ ID NO: 32517 - RNA, 21 nt, Artificial Sequence
  Description of Artificial Sequence: Synthetic oligonucleotide
uuuuaaauguaaguuuagguu

SEQ ID NO: 32518 - RNA, 21 nt, Artificial Sequence
  Description of Artificial Sequence: Synthetic oligonucleotide
uuuuuaaauguaaguuuaguu

SEQ ID NO: 32519 - RNA, 21 nt, Artificial Sequence
  Description of Artificial Sequence: Synthetic oligonucleotide
ucuuuuaaauguaaguuuauu

SEQ ID NO: 32520 - RNA, 21 nt, Artificial Sequence
  Description of Artificial Sequence: Synthetic oligonucleotide
uucuuuuaaauguaaguuuuu

SEQ ID NO: 32521 - RNA, 21 nt, Artificial Sequence
  Description of Artificial Sequence: Synthetic oligonucleotide
ugucuuuuaaauguaaguuuu

SEQ ID NO: 32522 - RNA, 21 nt, Artificial Sequence
  Description of Artificial Sequence: Synthetic oligonucleotide
uugucuuuuaaauguaaguuu

SEQ ID NO: 32523 - RNA, 21 nt, Artificial Sequence
  Description of Artificial Sequence: Synthetic oligonucleotide
ucugucuuuuaaauguaaguu

SEQ ID NO: 32524 - RNA, 21 nt, Artificial Sequence
  Description of Artificial Sequence: Synthetic oligonucleotide
uucugucuuuuaaauguaauu

SEQ ID NO: 32525 - RNA, 21 nt, Artificial Sequence
  Description of Artificial Sequence: Synthetic oligonucleotide
ugucugucuuuuaaauguauu

SEQ ID NO: 32526 - RNA, 21 nt, Artificial Sequence
  Description of Artificial Sequence: Synthetic oligonucleotide
uugucugucuuuuaaauguuu

SEQ ID NO: 32527 - RNA, 21 nt, Artificial Sequence
  Description of Artificial Sequence: Synthetic oligonucleotide
uaugucugucuuuuaaauguu

SEQ ID NO: 32528 - RNA, 21 nt, Artificial Sequence
  Description of Artificial Sequence: Synthetic oligonucleotide
uaaugucugucuuuuaaauuu

SEQ ID NO: 32529 - RNA, 21 nt, Artificial Sequence
  Description of Artificial Sequence: Synthetic oligonucleotide
ugaaugucugucuuuuaaauu

SEQ ID NO: 32530 - RNA, 21 nt, Artificial Sequence
  Description of Artificial Sequence: Synthetic oligonucleotide
uggaaugucugucuuuuaauu

SEQ ID NO: 32531 - RNA, 21 nt, Artificial Sequence
  Description of Artificial Sequence: Synthetic oligonucleotide
uaggaaugucugucuuuuauu

SEQ ID NO: 32532 - RNA, 21 nt, Artificial Sequence
  Description of Artificial Sequence: Synthetic oligonucleotide
uaaggaaugucugucuuuuuu

SEQ ID NO: 32533 - RNA, 21 nt, Artificial Sequence
  Description of Artificial Sequence: Synthetic oligonucleotide
ugaaggaaugucugucuuuuu

SEQ ID NO: 32534 - RNA, 21 nt, Artificial Sequence
  Description of Artificial Sequence: Synthetic oligonucleotide
uagaaggaaugucugucuuuu

SEQ ID NO: 32535 - RNA, 21 nt, Artificial Sequence
  Description of Artificial Sequence: Synthetic oligonucleotide
uuagaaggaaugucugucuuu

SEQ ID NO: 32536 - RNA, 21 nt, Artificial Sequence
  Description of Artificial Sequence: Synthetic oligonucleotide
uguagaaggaaugucugucuu

SEQ ID NO: 32537 - RNA, 21 nt, Artificial Sequence
  Description of Artificial Sequence: Synthetic oligonucleotide
uuguagaaggaaugucuguuu

SEQ ID NO: 32538 - RNA, 21 nt, Artificial Sequence
  Description of Artificial Sequence: Synthetic oligonucleotide
uauguagaaggaaugucuguu

SEQ ID NO: 32539 - RNA, 21 nt, Artificial Sequence
  Description of Artificial Sequence: Synthetic oligonucleotide
ucauguagaaggaaugucuuu

SEQ ID NO: 32540 - RNA, 21 nt, Artificial Sequence
  Description of Artificial Sequence: Synthetic oligonucleotide
uacauguagaaggaaugucuu

SEQ ID NO: 32541 - RNA, 21 nt, Artificial Sequence
  Description of Artificial Sequence: Synthetic oligonucleotide
uuacauguagaaggaauguuu

SEQ ID NO: 32542 - RNA, 21 nt, Artificial Sequence
  Description of Artificial Sequence: Synthetic oligonucleotide
uuuacauguagaaggaauguu

SEQ ID NO: 32543 - RNA, 21 nt, Artificial Sequence
  Description of Artificial Sequence: Synthetic oligonucleotide
uauuacauguagaaggaauuu

SEQ ID NO: 32544 - RNA, 21 nt, Artificial Sequence
  Description of Artificial Sequence: Synthetic oligonucleotide
ucauuacauguagaaggaauu

SEQ ID NO: 32545 - RNA, 21 nt, Artificial Sequence
  Description of Artificial Sequence: Synthetic oligonucleotide
uucauuacauguagaaggauu

SEQ ID NO: 32546 - RNA, 21 nt, Artificial Sequence
  Description of Artificial Sequence: Synthetic oligonucleotide
ugucauuacauguagaagguu

SEQ ID NO: 32547 - RNA, 21 nt, Artificial Sequence
  Description of Artificial Sequence: Synthetic oligonucleotide
uugucauuacauguagaaguu

SEQ ID NO: 32548 - RNA, 21 nt, Artificial Sequence
  Description of Artificial Sequence: Synthetic oligonucleotide
ugugucauuacauguagaauu

SEQ ID NO: 32549 - RNA, 21 nt, Artificial Sequence
  Description of Artificial Sequence: Synthetic oligonucleotide
uagugucauuacauguagauu

SEQ ID NO: 32550 - RNA, 21 nt, Artificial Sequence
  Description of Artificial Sequence: Synthetic oligonucleotide
uaagugucauuacauguaguu

SEQ ID NO: 32551 - RNA, 21 nt, Artificial Sequence
  Description of Artificial Sequence: Synthetic oligonucleotide
ugaagugucauuacauguauu

SEQ ID NO: 32552 - RNA, 21 nt, Artificial Sequence
  Description of Artificial Sequence: Synthetic oligonucleotide
uagaagugucauuacauguuu

SEQ ID NO: 32553 - RNA, 21 nt, Artificial Sequence
  Description of Artificial Sequence: Synthetic oligonucleotide
uaagaagugucauuacauguu

SEQ ID NO: 32554 - RNA, 21 nt, Artificial Sequence
  Description of Artificial Sequence: Synthetic oligonucleotide
ucaagaagugucauuacauuu

SEQ ID NO: 32555 - RNA, 21 nt, Artificial Sequence
  Description of Artificial Sequence: Synthetic oligonucleotide
uacaagaagugucauuacauu

SEQ ID NO: 32556 - RNA, 21 nt, Artificial Sequence
  Description of Artificial Sequence: Synthetic oligonucleotide
ucacaagaagugucauuacuu

SEQ ID NO: 32557 - RNA, 21 nt, Artificial Sequence
  Description of Artificial Sequence: Synthetic oligonucleotide
uacacaagaagugucauuauu

SEQ ID NO: 32558 - RNA, 21 nt, Artificial Sequence
  Description of Artificial Sequence: Synthetic oligonucleotide
uaacacaagaagugucauuuu

SEQ ID NO: 32559 - RNA, 21 nt, Artificial Sequence
  Description of Artificial Sequence: Synthetic oligonucleotide
uuaacacaagaagugucauuu

SEQ ID NO: 32560 - RNA, 21 nt, Artificial Sequence
  Description of Artificial Sequence: Synthetic oligonucleotide
uuuaacacaagaagugucauu

SEQ ID NO: 32561 - RNA, 21 nt, Artificial Sequence
  Description of Artificial Sequence: Synthetic oligonucleotide
uuuuaacacaagaagugucuu

SEQ ID NO: 32562 - RNA, 21 nt, Artificial Sequence
  Description of Artificial Sequence: Synthetic oligonucleotide
uguuuaacacaagaaguguuu

SEQ ID NO: 32563 - RNA, 21 nt, Artificial Sequence
  Description of Artificial Sequence: Synthetic oligonucleotide
uaguuuaacacaagaaguguu

SEQ ID NO: 32564 - RNA, 21 nt, Artificial Sequence
  Description of Artificial Sequence: Synthetic oligonucleotide
uuaguuuaacacaagaaguuu

SEQ ID NO: 32565 - RNA, 21 nt, Artificial Sequence
  Description of Artificial Sequence: Synthetic oligonucleotide
uuuaguuuaacacaagaaguu

SEQ ID NO: 32566 - RNA, 21 nt, Artificial Sequence
  Description of Artificial Sequence: Synthetic oligonucleotide
uuuuaguuuaacacaagaauu

SEQ ID NO: 32567 - RNA, 21 nt, Artificial Sequence
  Description of Artificial Sequence: Synthetic oligonucleotide
uuuuuaguuuaacacaagauu

SEQ ID NO: 32568 - RNA, 21 nt, Artificial Sequence
  Description of Artificial Sequence: Synthetic oligonucleotide
uuuuuuaguuuaacacaaguu

SEQ ID NO: 32569 - RNA, 21 nt, Artificial Sequence
  Description of Artificial Sequence: Synthetic oligonucleotide
uauuuuuaguuuaacacaauu

SEQ ID NO: 32570 - RNA, 21 nt, Artificial Sequence
  Description of Artificial Sequence: Synthetic oligonucleotide
uaauuuuuaguuuaacacauu

SEQ ID NO: 32571 - RNA, 21 nt, Artificial Sequence
  Description of Artificial Sequence: Synthetic oligonucleotide
uaaauuuuuaguuuaacacuu

SEQ ID NO: 32572 - RNA, 21 nt, Artificial Sequence
  Description of Artificial Sequence: Synthetic oligonucleotide
uuaaauuuuuaguuuaacauu

SEQ ID NO: 32573 - RNA, 21 nt, Artificial Sequence
  Description of Artificial Sequence: Synthetic oligonucleotide
uguaaauuuuuaguuuaacuu

SEQ ID NO: 32574 - RNA, 21 nt, Artificial Sequence
  Description of Artificial Sequence: Synthetic oligonucleotide
uuguaaauuuuuaguuuaauu

SEQ ID NO: 32575 - RNA, 21 nt, Artificial Sequence
  Description of Artificial Sequence: Synthetic oligonucleotide
uuuguaaauuuuuaguuuauu

SEQ ID NO: 32576 - RNA, 21 nt, Artificial Sequence
  Description of Artificial Sequence: Synthetic oligonucleotide
ucuuguaaauuuuuaguuuuu

SEQ ID NO: 32577 - RNA, 21 nt, Artificial Sequence
  Description of Artificial Sequence: Synthetic oligonucleotide
uucuuguaaauuuuuaguuuu

SEQ ID NO: 32578 - RNA, 21 nt, Artificial Sequence
  Description of Artificial Sequence: Synthetic oligonucleotide
ucucuuguaaauuuuuaguuu

SEQ ID NO: 32579 - RNA, 21 nt, Artificial Sequence
  Description of Artificial Sequence: Synthetic oligonucleotide
uucucuuguaaauuuuuaguu

SEQ ID NO: 32580 - RNA, 21 nt, Artificial Sequence
  Description of Artificial Sequence: Synthetic oligonucleotide
uuucucuuguaaauuuuuauu

SEQ ID NO: 32581 - RNA, 21 nt, Artificial Sequence
  Description of Artificial Sequence: Synthetic oligonucleotide
ucuucucuuguaaauuuuuuu

SEQ ID NO: 32582 - RNA, 21 nt, Artificial Sequence
  Description of Artificial Sequence: Synthetic oligonucleotide
uucuucucuuguaaauuuuuu

SEQ ID NO: 32583 - RNA, 21 nt, Artificial Sequence
  Description of Artificial Sequence: Synthetic oligonucleotide
uuucuucucuuguaaauuuuu

SEQ ID NO: 32584 - RNA, 21 nt, Artificial Sequence
  Description of Artificial Sequence: Synthetic oligonucleotide
uuuucuucucuuguaaauuuu

SEQ ID NO: 32585 - RNA, 21 nt, Artificial Sequence
  Description of Artificial Sequence: Synthetic oligonucleotide
ucuuucuucucuuguaaauuu

SEQ ID NO: 32586 - RNA, 21 nt, Artificial Sequence
  Description of Artificial Sequence: Synthetic oligonucleotide
uacuuucuucucuuguaaauu

SEQ ID NO: 32587 - RNA, 21 nt, Artificial Sequence
  Description of Artificial Sequence: Synthetic oligonucleotide
ucacuuucuucucuuguaauu

SEQ ID NO: 32588 - RNA, 21 nt, Artificial Sequence
  Description of Artificial Sequence: Synthetic oligonucleotide
uucacuuucuucucuuguauu

SEQ ID NO: 32589 - RNA, 21 nt, Artificial Sequence
  Description of Artificial Sequence: Synthetic oligonucleotide
uuucacuuucuucucuuguuu

SEQ ID NO: 32590 - RNA, 21 nt, Artificial Sequence
  Description of Artificial Sequence: Synthetic oligonucleotide
uuuucacuuucuucucuuguu

SEQ ID NO: 32591 - RNA, 21 nt, Artificial Sequence
  Description of Artificial Sequence: Synthetic oligonucleotide
ucuuucacuuucuucucuuuu

SEQ ID NO: 32592 - RNA, 21 nt, Artificial Sequence
  Description of Artificial Sequence: Synthetic oligonucleotide
ugcuuucacuuucuucucuuu

SEQ ID NO: 32593 - RNA, 21 nt, Artificial Sequence
  Description of Artificial Sequence: Synthetic oligonucleotide
uugcuuucacuuucuucucuu

SEQ ID NO: 32594 - RNA, 21 nt, Artificial Sequence
  Description of Artificial Sequence: Synthetic oligonucleotide
uuugcuuucacuuucuucuuu

SEQ ID NO: 32595 - RNA, 21 nt, Artificial Sequence
  Description of Artificial Sequence: Synthetic oligonucleotide
uuuugcuuucacuuucuucuu

SEQ ID NO: 32596 - RNA, 21 nt, Artificial Sequence
  Description of Artificial Sequence: Synthetic oligonucleotide
uauuugcuuucacuuucuuuu

SEQ ID NO: 32597 - RNA, 21 nt, Artificial Sequence
  Description of Artificial Sequence: Synthetic oligonucleotide
ucauuugcuuucacuuucuuu

SEQ ID NO: 32598 - RNA, 21 nt, Artificial Sequence
  Description of Artificial Sequence: Synthetic oligonucleotide
uccauuugcuuucacuuucuu

SEQ ID NO: 32599 - RNA, 21 nt, Artificial Sequence
  Description of Artificial Sequence: Synthetic oligonucleotide
ucccauuugcuuucacuuuuu

SEQ ID NO: 32600 - RNA, 21 nt, Artificial Sequence
  Description of Artificial Sequence: Synthetic oligonucleotide
uccccauuugcuuucacuuuu

SEQ ID NO: 32601 - RNA, 21 nt, Artificial Sequence
  Description of Artificial Sequence: Synthetic oligonucleotide
uaccccauuugcuuucacuuu

SEQ ID NO: 32602 - RNA, 21 nt, Artificial Sequence
  Description of Artificial Sequence: Synthetic oligonucleotide
uaaccccauuugcuuucacuu

SEQ ID NO: 32603 - RNA, 21 nt, Artificial Sequence
  Description of Artificial Sequence: Synthetic oligonucleotide
uaaaccccauuugcuuucauu

SEQ ID NO: 32604 - RNA, 21 nt, Artificial Sequence
  Description of Artificial Sequence: Synthetic oligonucleotide
ugaaaccccauuugcuuucuu

SEQ ID NO: 32605 - RNA, 21 nt, Artificial Sequence
  Description of Artificial Sequence: Synthetic oligonucleotide
uugaaaccccauuugcuuuuu

SEQ ID NO: 32606 - RNA, 21 nt, Artificial Sequence
  Description of Artificial Sequence: Synthetic oligonucleotide
ugugaaaccccauuugcuuuu

SEQ ID NO: 32607 - RNA, 21 nt, Artificial Sequence
  Description of Artificial Sequence: Synthetic oligonucleotide
uugugaaaccccauuugcuuu

SEQ ID NO: 32608 - RNA, 21 nt, Artificial Sequence
  Description of Artificial Sequence: Synthetic oligonucleotide
uuugugaaaccccauuugcuu

SEQ ID NO: 32609 - RNA, 21 nt, Artificial Sequence
  Description of Artificial Sequence: Synthetic oligonucleotide
uuuugugaaaccccauuuguu

SEQ ID NO: 32610 - RNA, 21 nt, Artificial Sequence
  Description of Artificial Sequence: Synthetic oligonucleotide
uauuugugaaaccccauuuuu

SEQ ID NO: 32611 - RNA, 21 nt, Artificial Sequence
  Description of Artificial Sequence: Synthetic oligonucleotide
uuauuugugaaaccccauuuu

SEQ ID NO: 32612 - RNA, 21 nt, Artificial Sequence
  Description of Artificial Sequence: Synthetic oligonucleotide
ucuauuugugaaaccccauuu

SEQ ID NO: 32613 - RNA, 21 nt, Artificial Sequence
  Description of Artificial Sequence: Synthetic oligonucleotide
uacuauuugugaaaccccauu

SEQ ID NO: 32614 - RNA, 21 nt, Artificial Sequence
  Description of Artificial Sequence: Synthetic oligonucleotide
uaacuauuugugaaaccccuu

SEQ ID NO: 32615 - RNA, 21 nt, Artificial Sequence
  Description of Artificial Sequence: Synthetic oligonucleotide
ucaacuauuugugaaacccuu

SEQ ID NO: 32616 - RNA, 21 nt, Artificial Sequence
  Description of Artificial Sequence: Synthetic oligonucleotide
uacaacuauuugugaaaccuu

SEQ ID NO: 32617 - RNA, 21 nt, Artificial Sequence
  Description of Artificial Sequence: Synthetic oligonucleotide
uuacaacuauuugugaaacuu

SEQ ID NO: 32618 - RNA, 21 nt, Artificial Sequence
  Description of Artificial Sequence: Synthetic oligonucleotide
uuuacaacuauuugugaaauu

SEQ ID NO: 32619 - RNA, 21 nt, Artificial Sequence
  Description of Artificial Sequence: Synthetic oligonucleotide
uuuuacaacuauuugugaauu

SEQ ID NO: 32620 - RNA, 21 nt, Artificial Sequence
  Description of Artificial Sequence: Synthetic oligonucleotide
uauuuacaacuauuugugauu

SEQ ID NO: 32621 - RNA, 21 nt, Artificial Sequence
  Description of Artificial Sequence: Synthetic oligonucleotide
uuauuuacaacuauuuguguu

SEQ ID NO: 32622 - RNA, 21 nt, Artificial Sequence
  Description of Artificial Sequence: Synthetic oligonucleotide
uauauuuacaacuauuuguuu

SEQ ID NO: 32623 - RNA, 21 nt, Artificial Sequence
  Description of Artificial Sequence: Synthetic oligonucleotide
uuauauuuacaacuauuuguu

SEQ ID NO: 32624 - RNA, 21 nt, Artificial Sequence
  Description of Artificial Sequence: Synthetic oligonucleotide
ucuauauuuacaacuauuuuu

SEQ ID NO: 32625 - RNA, 21 nt, Artificial Sequence
  Description of Artificial Sequence: Synthetic oligonucleotide
uacuauauuuacaacuauuuu

SEQ ID NO: 32626 - RNA, 21 nt, Artificial Sequence
  Description of Artificial Sequence: Synthetic oligonucleotide
ucacuauauuuacaacuauuu

SEQ ID NO: 32627 - RNA, 21 nt, Artificial Sequence
  Description of Artificial Sequence: Synthetic oligonucleotide
uucacuauauuuacaacuauu

SEQ ID NO: 32628 - RNA, 21 nt, Artificial Sequence
  Description of Artificial Sequence: Synthetic oligonucleotide
uuucacuauauuuacaacuuu

SEQ ID NO: 32629 - RNA, 21 nt, Artificial Sequence
  Description of Artificial Sequence: Synthetic oligonucleotide
ucuucacuauauuuacaacuu

SEQ ID NO: 32630 - RNA, 21 nt, Artificial Sequence
  Description of Artificial Sequence: Synthetic oligonucleotide
ugcuucacuauauuuacaauu

SEQ ID NO: 32631 - RNA, 21 nt, Artificial Sequence
  Description of Artificial Sequence: Synthetic oligonucleotide
uugcuucacuauauuuacauu

SEQ ID NO: 32632 - RNA, 21 nt, Artificial Sequence
  Description of Artificial Sequence: Synthetic oligonucleotide
uuugcuucacuauauuuacuu

SEQ ID NO: 32633 - RNA, 21 nt, Artificial Sequence
  Description of Artificial Sequence: Synthetic oligonucleotide
uauugcuucacuauauuuauu

SEQ ID NO: 32634 - RNA, 21 nt, Artificial Sequence
  Description of Artificial Sequence: Synthetic oligonucleotide
uaauugcuucacuauauuuuu

SEQ ID NO: 32635 - RNA, 21 nt, Artificial Sequence
  Description of Artificial Sequence: Synthetic oligonucleotide
uaaauugcuucacuauauuuu

SEQ ID NO: 32636 - RNA, 21 nt, Artificial Sequence
  Description of Artificial Sequence: Synthetic oligonucleotide
ucaaauugcuucacuauauuu

SEQ ID NO: 32637 - RNA, 21 nt, Artificial Sequence
  Description of Artificial Sequence: Synthetic oligonucleotide
uucaaauugcuucacuauauu

SEQ ID NO: 32638 - RNA, 21 nt, Artificial Sequence
  Description of Artificial Sequence: Synthetic oligonucleotide
uuucaaauugcuucacuauuu

SEQ ID NO: 32639 - RNA, 21 nt, Artificial Sequence
  Description of Artificial Sequence: Synthetic oligonucleotide
uuuucaaauugcuucacuauu

SEQ ID NO: 32640 - RNA, 21 nt, Artificial Sequence
  Description of Artificial Sequence: Synthetic oligonucleotide
uauuucaaauugcuucacuuu

SEQ ID NO: 32641 - RNA, 21 nt, Artificial Sequence
  Description of Artificial Sequence: Synthetic oligonucleotide
uuauuucaaauugcuucacuu

SEQ ID NO: 32642 - RNA, 21 nt, Artificial Sequence
  Description of Artificial Sequence: Synthetic oligonucleotide
uuuauuucaaauugcuucauu

SEQ ID NO: 32643 - RNA, 21 nt, Artificial Sequence
  Description of Artificial Sequence: Synthetic oligonucleotide
uauuauuucaaauugcuucuu

SEQ ID NO: 32644 - RNA, 21 nt, Artificial Sequence
  Description of Artificial Sequence: Synthetic oligonucleotide
uaauuauuucaaauugcuuuu

SEQ ID NO: 32645 - RNA, 21 nt, Artificial Sequence
  Description of Artificial Sequence: Synthetic oligonucleotide
uaaauuauuucaaauugcuuu

SEQ ID NO: 32646 - RNA, 21 nt, Artificial Sequence
  Description of Artificial Sequence: Synthetic oligonucleotide
uaaaauuauuucaaauugcuu

SEQ ID NO: 32647 - RNA, 21 nt, Artificial Sequence
  Description of Artificial Sequence: Synthetic oligonucleotide
ugaaaauuauuucaaauuguu

SEQ ID NO: 32648 - RNA, 21 nt, Artificial Sequence
  Description of Artificial Sequence: Synthetic oligonucleotide
uugaaaauuauuucaaauuuu

SEQ ID NO: 32649 - RNA, 21 nt, Artificial Sequence
  Description of Artificial Sequence: Synthetic oligonucleotide
uuugaaaauuauuucaaauuu

SEQ ID NO: 32650 - RNA, 21 nt, Artificial Sequence
  Description of Artificial Sequence: Synthetic oligonucleotide
ucuugaaaauuauuucaaauu

SEQ ID NO: 32651 - RNA, 21 nt, Artificial Sequence
  Description of Artificial Sequence: Synthetic oligonucleotide
ugcuugaaaauuauuucaauu

SEQ ID NO: 32652 - RNA, 21 nt, Artificial Sequence
  Description of Artificial Sequence: Synthetic oligonucleotide
uugcuugaaaauuauuucauu

SEQ ID NO: 32653 - RNA, 21 nt, Artificial Sequence
  Description of Artificial Sequence: Synthetic oligonucleotide
uuugcuugaaaauuauuucuu

SEQ ID NO: 32654 - RNA, 21 nt, Artificial Sequence
  Description of Artificial Sequence: Synthetic oligonucleotide
uuuugcuugaaaauuauuuuu

SEQ ID NO: 32655 - RNA, 21 nt, Artificial Sequence
  Description of Artificial Sequence: Synthetic oligonucleotide
ucuuugcuugaaaauuauuuu

SEQ ID NO: 32656 - RNA, 21 nt, Artificial Sequence
  Description of Artificial Sequence: Synthetic oligonucleotide
uacuuugcuugaaaauuauuu

SEQ ID NO: 32657 - RNA, 21 nt, Artificial Sequence
  Description of Artificial Sequence: Synthetic oligonucleotide
uuacuuugcuugaaaauuauu

SEQ ID NO: 32658 - RNA, 21 nt, Artificial Sequence
  Description of Artificial Sequence: Synthetic oligonucleotide
uauacuuugcuugaaaauuuu

SEQ ID NO: 32659 - RNA, 21 nt, Artificial Sequence
  Description of Artificial Sequence: Synthetic oligonucleotide
uaauacuuugcuugaaaauuu

SEQ ID NO: 32660 - RNA, 21 nt, Artificial Sequence
  Description of Artificial Sequence: Synthetic oligonucleotide
ucaauacuuugcuugaaaauu

SEQ ID NO: 32661 - RNA, 21 nt, Artificial Sequence
  Description of Artificial Sequence: Synthetic oligonucleotide
uacaauacuuugcuugaaauu

SEQ ID NO: 32662 - RNA, 21 nt, Artificial Sequence
  Description of Artificial Sequence: Synthetic oligonucleotide
ucacaauacuuugcuugaauu

SEQ ID NO: 32663 - RNA, 21 nt, Artificial Sequence
  Description of Artificial Sequence: Synthetic oligonucleotide
uucacaauacuuugcuugauu

SEQ ID NO: 32664 - RNA, 21 nt, Artificial Sequence
  Description of Artificial Sequence: Synthetic oligonucleotide
uuucacaauacuuugcuuguu

SEQ ID NO: 32665 - RNA, 21 nt, Artificial Sequence
  Description of Artificial Sequence: Synthetic oligonucleotide
uuuucacaauacuuugcuuuu

SEQ ID NO: 32666 - RNA, 21 nt, Artificial Sequence
  Description of Artificial Sequence: Synthetic oligonucleotide
ucuuucacaauacuuugcuuu

SEQ ID NO: 32667 - RNA, 21 nt, Artificial Sequence
  Description of Artificial Sequence: Synthetic oligonucleotide
uacuuucacaauacuuugcuu

SEQ ID NO: 32668 - RNA, 21 nt, Artificial Sequence
  Description of Artificial Sequence: Synthetic oligonucleotide
uuacuuucacaauacuuuguu

SEQ ID NO: 32669 - RNA, 21 nt, Artificial Sequence
  Description of Artificial Sequence: Synthetic oligonucleotide
uauacuuucacaauacuuuuu

SEQ ID NO: 32670 - RNA, 21 nt, Artificial Sequence
  Description of Artificial Sequence: Synthetic oligonucleotide
uaauacuuucacaauacuuuu

SEQ ID NO: 32671 - RNA, 21 nt, Artificial Sequence
  Description of Artificial Sequence: Synthetic oligonucleotide
ugaauacuuucacaauacuuu

SEQ ID NO: 32672 - RNA, 21 nt, Artificial Sequence
  Description of Artificial Sequence: Synthetic oligonucleotide
uagaauacuuucacaauacuu

SEQ ID NO: 32673 - RNA, 21 nt, Artificial Sequence
  Description of Artificial Sequence: Synthetic oligonucleotide
uuagaauacuuucacaauauu

SEQ ID NO: 32674 - RNA, 21 nt, Artificial Sequence
  Description of Artificial Sequence: Synthetic oligonucleotide
uuuagaauacuuucacaauuu

SEQ ID NO: 32675 - RNA, 21 nt, Artificial Sequence
  Description of Artificial Sequence: Synthetic oligonucleotide
ucuuagaauacuuucacaauu

SEQ ID NO: 32676 - RNA, 21 nt, Artificial Sequence
  Description of Artificial Sequence: Synthetic oligonucleotide
ugcuuagaauacuuucacauu

SEQ ID NO: 32677 - RNA, 21 nt, Artificial Sequence
  Description of Artificial Sequence: Synthetic oligonucleotide
uggcuuagaauacuuucacuu

SEQ ID NO: 32678 - RNA, 21 nt, Artificial Sequence
  Description of Artificial Sequence: Synthetic oligonucleotide
uuggcuuagaauacuuucauu

SEQ ID NO: 32679 - RNA, 21 nt, Artificial Sequence
  Description of Artificial Sequence: Synthetic oligonucleotide
uuuggcuuagaauacuuucuu

SEQ ID NO: 32680 - RNA, 21 nt, Artificial Sequence
  Description of Artificial Sequence: Synthetic oligonucleotide
ucuuggcuuagaauacuuuuu

SEQ ID NO: 32681 - RNA, 21 nt, Artificial Sequence
  Description of Artificial Sequence: Synthetic oligonucleotide
uacuuggcuuagaauacuuuu

SEQ ID NO: 32682 - RNA, 21 nt, Artificial Sequence
  Description of Artificial Sequence: Synthetic oligonucleotide
uaacuuggcuuagaauacuuu

SEQ ID NO: 32683 - RNA, 21 nt, Artificial Sequence
  Description of Artificial Sequence: Synthetic oligonucleotide
uaaacuuggcuuagaauacuu

SEQ ID NO: 32684 - RNA, 21 nt, Artificial Sequence
  Description of Artificial Sequence: Synthetic oligonucleotide
uaaaacuuggcuuagaauauu

SEQ ID NO: 32685 - RNA, 21 nt, Artificial Sequence
  Description of Artificial Sequence: Synthetic oligonucleotide
uuaaaacuuggcuuagaauuu

SEQ ID NO: 32686 - RNA, 21 nt, Artificial Sequence
  Description of Artificial Sequence: Synthetic oligonucleotide
uuuaaaacuuggcuuagaauu

SEQ ID NO: 32687 - RNA, 21 nt, Artificial Sequence
  Description of Artificial Sequence: Synthetic oligonucleotide
uuuuaaaacuuggcuuagauu

SEQ ID NO: 32688 - RNA, 21 nt, Artificial Sequence
  Description of Artificial Sequence: Synthetic oligonucleotide
uauuuaaaacuuggcuuaguu

SEQ ID NO: 32689 - RNA, 21 nt, Artificial Sequence
  Description of Artificial Sequence: Synthetic oligonucleotide
uuauuuaaaacuuggcuuauu

SEQ ID NO: 32690 - RNA, 21 nt, Artificial Sequence
  Description of Artificial Sequence: Synthetic oligonucleotide
uauauuuaaaacuuggcuuuu

SEQ ID NO: 32691 - RNA, 21 nt, Artificial Sequence
  Description of Artificial Sequence: Synthetic oligonucleotide
uaauauuuaaaacuuggcuuu

SEQ ID NO: 32692 - RNA, 21 nt, Artificial Sequence
  Description of Artificial Sequence: Synthetic oligonucleotide
uuaauauuuaaaacuuggcuu

SEQ ID NO: 32693 - RNA, 21 nt, Artificial Sequence
  Description of Artificial Sequence: Synthetic oligonucleotide
uauaauauuuaaaacuugguu

SEQ ID NO: 32694 - RNA, 21 nt, Artificial Sequence
  Description of Artificial Sequence: Synthetic oligonucleotide
ugauaauauuuaaaacuuguu

SEQ ID NO: 32695 - RNA, 21 nt, Artificial Sequence
  Description of Artificial Sequence: Synthetic oligonucleotide
uagauaauauuuaaaacuuuu

SEQ ID NO: 32696 - RNA, 21 nt, Artificial Sequence
  Description of Artificial Sequence: Synthetic oligonucleotide
uuagauaauauuuaaaacuuu

SEQ ID NO: 32697 - RNA, 21 nt, Artificial Sequence
  Description of Artificial Sequence: Synthetic oligonucleotide
uuuagauaauauuuaaaacuu

SEQ ID NO: 32698 - RNA, 21 nt, Artificial Sequence
  Description of Artificial Sequence: Synthetic oligonucleotide
uguuagauaauauuuaaaauu

SEQ ID NO: 32699 - RNA, 21 nt, Artificial Sequence
  Description of Artificial Sequence: Synthetic oligonucleotide
uuguuagauaauauuuaaauu

SEQ ID NO: 32700 - RNA, 21 nt, Artificial Sequence
  Description of Artificial Sequence: Synthetic oligonucleotide
ucuguuagauaauauuuaauu

SEQ ID NO: 32701 - RNA, 21 nt, Artificial Sequence
  Description of Artificial Sequence: Synthetic oligonucleotide
uucuguuagauaauauuuauu

SEQ ID NO: 32702 - RNA, 21 nt, Artificial Sequence
  Description of Artificial Sequence: Synthetic oligonucleotide
ugucuguuagauaauauuuuu

SEQ ID NO: 32703 - RNA, 21 nt, Artificial Sequence
  Description of Artificial Sequence: Synthetic oligonucleotide
uugucuguuagauaauauuuu

SEQ ID NO: 32704 - RNA, 21 nt, Artificial Sequence
  Description of Artificial Sequence: Synthetic oligonucleotide
uuugucuguuagauaauauuu

SEQ ID NO: 32705 - RNA, 21 nt, Artificial Sequence
  Description of Artificial Sequence: Synthetic oligonucleotide
ucuugucuguuagauaauauu

SEQ ID NO: 32706 - RNA, 21 nt, Artificial Sequence
  Description of Artificial Sequence: Synthetic oligonucleotide
uucuugucuguuagauaauuu

SEQ ID NO: 32707 - RNA, 21 nt, Artificial Sequence
  Description of Artificial Sequence: Synthetic oligonucleotide
ucucuugucuguuagauaauu

SEQ ID NO: 32708 - RNA, 21 nt, Artificial Sequence
  Description of Artificial Sequence: Synthetic oligonucleotide
uacucuugucuguuagauauu

SEQ ID NO: 32709 - RNA, 21 nt, Artificial Sequence
  Description of Artificial Sequence: Synthetic oligonucleotide
ucacucuugucuguuagauuu

SEQ ID NO: 32710 - RNA, 21 nt, Artificial Sequence
  Description of Artificial Sequence: Synthetic oligonucleotide
uccacucuugucuguuagauu

SEQ ID NO: 32711 - RNA, 21 nt, Artificial Sequence
  Description of Artificial Sequence: Synthetic oligonucleotide
uaccacucuugucuguuaguu

SEQ ID NO: 32712 - RNA, 21 nt, Artificial Sequence
  Description of Artificial Sequence: Synthetic oligonucleotide
uuaccacucuugucuguuauu

SEQ ID NO: 32713 - RNA, 21 nt, Artificial Sequence
  Description of Artificial Sequence: Synthetic oligonucleotide
uauaccacucuugucuguuuu

SEQ ID NO: 32714 - RNA, 21 nt, Artificial Sequence
  Description of Artificial Sequence: Synthetic oligonucleotide
uuauaccacucuugucuguuu

SEQ ID NO: 32715 - RNA, 21 nt, Artificial Sequence
  Description of Artificial Sequence: Synthetic oligonucleotide
uauauaccacucuugucuguu

SEQ ID NO: 32716 - RNA, 21 nt, Artificial Sequence
  Description of Artificial Sequence: Synthetic oligonucleotide
uuauauaccacucuugucuuu

SEQ ID NO: 32717 - RNA, 21 nt, Artificial Sequence
  Description of Artificial Sequence: Synthetic oligonucleotide
uguauauaccacucuugucuu

SEQ ID NO: 32718 - RNA, 21 nt, Artificial Sequence
  Description of Artificial Sequence: Synthetic oligonucleotide
uuguauauaccacucuuguuu

SEQ ID NO: 32719 - RNA, 21 nt, Artificial Sequence
  Description of Artificial Sequence: Synthetic oligonucleotide
uuuguauauaccacucuuguu

SEQ ID NO: 32720 - RNA, 21 nt, Artificial Sequence
  Description of Artificial Sequence: Synthetic oligonucleotide
ucuuguauauaccacucuuuu

SEQ ID NO: 32721 - RNA, 21 nt, Artificial Sequence
  Description of Artificial Sequence: Synthetic oligonucleotide
uacuuguauauaccacucuuu

SEQ ID NO: 32722 - RNA, 21 nt, Artificial Sequence
  Description of Artificial Sequence: Synthetic oligonucleotide
uuacuuguauauaccacucuu

SEQ ID NO: 32723 - RNA, 21 nt, Artificial Sequence
  Description of Artificial Sequence: Synthetic oligonucleotide
ucuacuuguauauaccacuuu

SEQ ID NO: 32724 - RNA, 21 nt, Artificial Sequence
  Description of Artificial Sequence: Synthetic oligonucleotide
uucuacuuguauauaccacuu

SEQ ID NO: 32725 - RNA, 21 nt, Artificial Sequence
  Description of Artificial Sequence: Synthetic oligonucleotide
uaucuacuuguauauaccauu

SEQ ID NO: 32726 - RNA, 21 nt, Artificial Sequence
  Description of Artificial Sequence: Synthetic oligonucleotide
ugaucuacuuguauauaccuu

SEQ ID NO: 32727 - RNA, 21 nt, Artificial Sequence
  Description of Artificial Sequence: Synthetic oligonucleotide
uggaucuacuuguauauacuu

SEQ ID NO: 32728 - RNA, 21 nt, Artificial Sequence
  Description of Artificial Sequence: Synthetic oligonucleotide
uaggaucuacuuguauauauu

SEQ ID NO: 32729 - RNA, 21 nt, Artificial Sequence
  Description of Artificial Sequence: Synthetic oligonucleotide
ucaggaucuacuuguauauuu

SEQ ID NO: 32730 - RNA, 21 nt, Artificial Sequence
  Description of Artificial Sequence: Synthetic oligonucleotide
uucaggaucuacuuguauauu

SEQ ID NO: 32731 - RNA, 21 nt, Artificial Sequence
  Description of Artificial Sequence: Synthetic oligonucleotide
ucucaggaucuacuuguauuu

SEQ ID NO: 32732 - RNA, 21 nt, Artificial Sequence
  Description of Artificial Sequence: Synthetic oligonucleotide
uucucaggaucuacuuguauu

SEQ ID NO: 32733 - RNA, 21 nt, Artificial Sequence
  Description of Artificial Sequence: Synthetic oligonucleotide
uuucucaggaucuacuuguuu

SEQ ID NO: 32734 - RNA, 21 nt, Artificial Sequence
  Description of Artificial Sequence: Synthetic oligonucleotide
ucuucucaggaucuacuuguu

SEQ ID NO: 32735 - RNA, 21 nt, Artificial Sequence
  Description of Artificial Sequence: Synthetic oligonucleotide
uacuucucaggaucuacuuuu

SEQ ID NO: 32736 - RNA, 21 nt, Artificial Sequence
  Description of Artificial Sequence: Synthetic oligonucleotide
uuacuucucaggaucuacuuu

SEQ ID NO: 32737 - RNA, 21 nt, Artificial Sequence
  Description of Artificial Sequence: Synthetic oligonucleotide
uguacuucucaggaucuacuu

SEQ ID NO: 32738 - RNA, 21 nt, Artificial Sequence
  Description of Artificial Sequence: Synthetic oligonucleotide
ugguacuucucaggaucuauu

SEQ ID NO: 32739 - RNA, 21 nt, Artificial Sequence
  Description of Artificial Sequence: Synthetic oligonucleotide
uagguacuucucaggaucuuu

SEQ ID NO: 32740 - RNA, 21 nt, Artificial Sequence
  Description of Artificial Sequence: Synthetic oligonucleotide
uaagguacuucucaggaucuu

SEQ ID NO: 32741 - RNA, 21 nt, Artificial Sequence
  Description of Artificial Sequence: Synthetic oligonucleotide
uaaagguacuucucaggauuu

SEQ ID NO: 32742 - RNA, 21 nt, Artificial Sequence
  Description of Artificial Sequence: Synthetic oligonucleotide
ucaaagguacuucucaggauu

SEQ ID NO: 32743 - RNA, 21 nt, Artificial Sequence
  Description of Artificial Sequence: Synthetic oligonucleotide
uacaaagguacuucucagguu

SEQ ID NO: 32744 - RNA, 21 nt, Artificial Sequence
  Description of Artificial Sequence: Synthetic oligonucleotide
uaacaaagguacuucucaguu

SEQ ID NO: 32745 - RNA, 21 nt, Artificial Sequence
  Description of Artificial Sequence: Synthetic oligonucleotide
uuaacaaagguacuucucauu

SEQ ID NO: 32746 - RNA, 21 nt, Artificial Sequence
  Description of Artificial Sequence: Synthetic oligonucleotide
uguaacaaagguacuucucuu

SEQ ID NO: 32747 - RNA, 21 nt, Artificial Sequence
  Description of Artificial Sequence: Synthetic oligonucleotide
uuguaacaaagguacuucuuu

SEQ ID NO: 32748 - RNA, 21 nt, Artificial Sequence
  Description of Artificial Sequence: Synthetic oligonucleotide
ucuguaacaaagguacuucuu

SEQ ID NO: 32749 - RNA, 21 nt, Artificial Sequence
  Description of Artificial Sequence: Synthetic oligonucleotide
ugcuguaacaaagguacuuuu

SEQ ID NO: 32750 - RNA, 21 nt, Artificial Sequence
  Description of Artificial Sequence: Synthetic oligonucleotide
uagcuguaacaaagguacuuu

SEQ ID NO: 32751 - RNA, 21 nt, Artificial Sequence
  Description of Artificial Sequence: Synthetic oligonucleotide
uuagcuguaacaaagguacuu

SEQ ID NO: 32752 - RNA, 21 nt, Artificial Sequence
  Description of Artificial Sequence: Synthetic oligonucleotide
uguagcuguaacaaagguauu

SEQ ID NO: 32753 - RNA, 21 nt, Artificial Sequence
  Description of Artificial Sequence: Synthetic oligonucleotide
uaguagcuguaacaaagguuu

SEQ ID NO: 32754 - RNA, 21 nt, Artificial Sequence
  Description of Artificial Sequence: Synthetic oligonucleotide
uuaguagcuguaacaaagguu

SEQ ID NO: 32755 - RNA, 21 nt, Artificial Sequence
  Description of Artificial Sequence: Synthetic oligonucleotide
uauaguagcuguaacaaaguu

SEQ ID NO: 32756 - RNA, 21 nt, Artificial Sequence
  Description of Artificial Sequence: Synthetic oligonucleotide
uuauaguagcuguaacaaauu

SEQ ID NO: 32757 - RNA, 21 nt, Artificial Sequence
  Description of Artificial Sequence: Synthetic oligonucleotide
uuuauaguagcuguaacaauu

SEQ ID NO: 32758 - RNA, 21 nt, Artificial Sequence
  Description of Artificial Sequence: Synthetic oligonucleotide
uuuuauaguagcuguaacauu

SEQ ID NO: 32759 - RNA, 21 nt, Artificial Sequence
  Description of Artificial Sequence: Synthetic oligonucleotide
uauuuauaguagcuguaacuu

SEQ ID NO: 32760 - RNA, 21 nt, Artificial Sequence
  Description of Artificial Sequence: Synthetic oligonucleotide
uuauuuauaguagcuguaauu

SEQ ID NO: 32761 - RNA, 21 nt, Artificial Sequence
  Description of Artificial Sequence: Synthetic oligonucleotide
uauauuuauaguagcuguauu

SEQ ID NO: 32762 - RNA, 21 nt, Artificial Sequence
  Description of Artificial Sequence: Synthetic oligonucleotide
uuauauuuauaguagcuguuu

SEQ ID NO: 32763 - RNA, 21 nt, Artificial Sequence
  Description of Artificial Sequence: Synthetic oligonucleotide
uguauauuuauaguagcuguu

SEQ ID NO: 32764 - RNA, 21 nt, Artificial Sequence
  Description of Artificial Sequence: Synthetic oligonucleotide
uuguauauuuauaguagcuuu

SEQ ID NO: 32765 - RNA, 21 nt, Artificial Sequence
  Description of Artificial Sequence: Synthetic oligonucleotide
uauguauauuuauaguagcuu

SEQ ID NO: 32766 - RNA, 21 nt, Artificial Sequence
  Description of Artificial Sequence: Synthetic oligonucleotide
uuauguauauuuauaguaguu

SEQ ID NO: 32767 - RNA, 21 nt, Artificial Sequence
  Description of Artificial Sequence: Synthetic oligonucleotide
uauauguauauuuauaguauu

SEQ ID NO: 32768 - RNA, 21 nt, Artificial Sequence
  Description of Artificial Sequence: Synthetic oligonucleotide
uuauauguauauuuauaguuu

SEQ ID NO: 32769 - RNA, 21 nt, Artificial Sequence
  Description of Artificial Sequence: Synthetic oligonucleotide
uuuauauguauauuuauaguu

SEQ ID NO: 32770 - RNA, 21 nt, Artificial Sequence
  Description of Artificial Sequence: Synthetic oligonucleotide
uuuuauauguauauuuauauu

SEQ ID NO: 32771 - RNA, 21 nt, Artificial Sequence
  Description of Artificial Sequence: Synthetic oligonucleotide
uauuuauauguauauuuauuu

SEQ ID NO: 32772 - RNA, 21 nt, Artificial Sequence
  Description of Artificial Sequence: Synthetic oligonucleotide
uaauuuauauguauauuuauu

SEQ ID NO: 32773 - RNA, 21 nt, Artificial Sequence
  Description of Artificial Sequence: Synthetic oligonucleotide
uuaauuuauauguauauuuuu

SEQ ID NO: 32774 - RNA, 21 nt, Artificial Sequence
  Description of Artificial Sequence: Synthetic oligonucleotide
uauaauuuauauguauauuuu

SEQ ID NO: 32775 - RNA, 21 nt, Artificial Sequence
  Description of Artificial Sequence: Synthetic oligonucleotide
uuauaauuuauauguauauuu

SEQ ID NO: 32776 - RNA, 21 nt, Artificial Sequence
  Description of Artificial Sequence: Synthetic oligonucleotide
ucuauaauuuauauguauauu

SEQ ID NO: 32777 - RNA, 21 nt, Artificial Sequence
  Description of Artificial Sequence: Synthetic oligonucleotide
uucuauaauuuauauguauuu

SEQ ID NO: 32778 - RNA, 21 nt, Artificial Sequence
  Description of Artificial Sequence: Synthetic oligonucleotide
uuucuauaauuuauauguauu

SEQ ID NO: 32779 - RNA, 21 nt, Artificial Sequence
  Description of Artificial Sequence: Synthetic oligonucleotide
uauucuauaauuuauauguuu

SEQ ID NO: 32780 - RNA, 21 nt, Artificial Sequence
  Description of Artificial Sequence: Synthetic oligonucleotide
ugauucuauaauuuauauguu

SEQ ID NO: 32781 - RNA, 21 nt, Artificial Sequence
  Description of Artificial Sequence: Synthetic oligonucleotide
uagauucuauaauuuauauuu

SEQ ID NO: 32782 - RNA, 21 nt, Artificial Sequence
  Description of Artificial Sequence: Synthetic oligonucleotide
uuagauucuauaauuuauauu

SEQ ID NO: 32783 - RNA, 21 nt, Artificial Sequence
  Description of Artificial Sequence: Synthetic oligonucleotide
uguagauucuauaauuuauuu

SEQ ID NO: 32784 - RNA, 21 nt, Artificial Sequence
  Description of Artificial Sequence: Synthetic oligonucleotide
uaguagauucuauaauuuauu

SEQ ID NO: 32785 - RNA, 21 nt, Artificial Sequence
  Description of Artificial Sequence: Synthetic oligonucleotide
uaaguagauucuauaauuuuu

SEQ ID NO: 32786 - RNA, 21 nt, Artificial Sequence
  Description of Artificial Sequence: Synthetic oligonucleotide
uaaaguagauucuauaauuuu

SEQ ID NO: 32787 - RNA, 21 nt, Artificial Sequence
  Description of Artificial Sequence: Synthetic oligonucleotide
uuaaaguagauucuauaauuu

SEQ ID NO: 32788 - RNA, 21 nt, Artificial Sequence
  Description of Artificial Sequence: Synthetic oligonucleotide
uuuaaaguagauucuauaauu

SEQ ID NO: 32789 - RNA, 21 nt, Artificial Sequence
  Description of Artificial Sequence: Synthetic oligonucleotide
uauuaaaguagauucuauauu

SEQ ID NO: 32790 - RNA, 21 nt, Artificial Sequence
  Description of Artificial Sequence: Synthetic oligonucleotide
uaauuaaaguagauucuauuu

SEQ ID NO: 32791 - RNA, 21 nt, Artificial Sequence
  Description of Artificial Sequence: Synthetic oligonucleotide
uaaauuaaaguagauucuauu

SEQ ID NO: 32792 - RNA, 21 nt, Artificial Sequence
  Description of Artificial Sequence: Synthetic oligonucleotide
uuaaauuaaaguagauucuuu

SEQ ID NO: 32793 - RNA, 21 nt, Artificial Sequence
  Description of Artificial Sequence: Synthetic oligonucleotide
uauaaauuaaaguagauucuu

SEQ ID NO: 32794 - RNA, 21 nt, Artificial Sequence
  Description of Artificial Sequence: Synthetic oligonucleotide
uaauaaauuaaaguagauuuu

SEQ ID NO: 32795 - RNA, 21 nt, Artificial Sequence
  Description of Artificial Sequence: Synthetic oligonucleotide
uaaauaaauuaaaguagauuu

SEQ ID NO: 32796 - RNA, 21 nt, Artificial Sequence
  Description of Artificial Sequence: Synthetic oligonucleotide
uaaaauaaauuaaaguagauu

SEQ ID NO: 32797 - RNA, 21 nt, Artificial Sequence
  Description of Artificial Sequence: Synthetic oligonucleotide
ucaaaauaaauuaaaguaguu

SEQ ID NO: 32798 - RNA, 21 nt, Artificial Sequence
  Description of Artificial Sequence: Synthetic oligonucleotide
uacaaaauaaauuaaaguauu

SEQ ID NO: 32799 - RNA, 21 nt, Artificial Sequence
  Description of Artificial Sequence: Synthetic oligonucleotide
ucacaaaauaaauuaaaguuu

SEQ ID NO: 32800 - RNA, 21 nt, Artificial Sequence
  Description of Artificial Sequence: Synthetic oligonucleotide
uucacaaaauaaauuaaaguu

SEQ ID NO: 32801 - RNA, 21 nt, Artificial Sequence
  Description of Artificial Sequence: Synthetic oligonucleotide
uuucacaaaauaaauuaaauu

SEQ ID NO: 32802 - RNA, 21 nt, Artificial Sequence
  Description of Artificial Sequence: Synthetic oligonucleotide
uguucacaaaauaaauuaauu

SEQ ID NO: 32803 - RNA, 21 nt, Artificial Sequence
  Description of Artificial Sequence: Synthetic oligonucleotide
uuguucacaaaauaaauuauu

SEQ ID NO: 32804 - RNA, 21 nt, Artificial Sequence
  Description of Artificial Sequence: Synthetic oligonucleotide
uguguucacaaaauaaauuuu

SEQ ID NO: 32805 - RNA, 21 nt, Artificial Sequence
  Description of Artificial Sequence: Synthetic oligonucleotide
uaguguucacaaaauaaauuu

SEQ ID NO: 32806 - RNA, 21 nt, Artificial Sequence
  Description of Artificial Sequence: Synthetic oligonucleotide
uaaguguucacaaaauaaauu

SEQ ID NO: 32807 - RNA, 21 nt, Artificial Sequence
  Description of Artificial Sequence: Synthetic oligonucleotide
uaaaguguucacaaaauaauu

SEQ ID NO: 32808 - RNA, 21 nt, Artificial Sequence
  Description of Artificial Sequence: Synthetic oligonucleotide
uaaaaguguucacaaaauauu

SEQ ID NO: 32809 - RNA, 21 nt, Artificial Sequence
  Description of Artificial Sequence: Synthetic oligonucleotide
ucaaaaguguucacaaaauuu

SEQ ID NO: 32810 - RNA, 21 nt, Artificial Sequence
  Description of Artificial Sequence: Synthetic oligonucleotide
uucaaaaguguucacaaaauu

SEQ ID NO: 32811 - RNA, 21 nt, Artificial Sequence
  Description of Artificial Sequence: Synthetic oligonucleotide
uuucaaaaguguucacaaauu

SEQ ID NO: 32812 - RNA, 21 nt, Artificial Sequence
  Description of Artificial Sequence: Synthetic oligonucleotide
uuuucaaaaguguucacaauu

SEQ ID NO: 32813 - RNA, 21 nt, Artificial Sequence
  Description of Artificial Sequence: Synthetic oligonucleotide
uuuuucaaaaguguucacauu

SEQ ID NO: 32814 - RNA, 21 nt, Artificial Sequence
  Description of Artificial Sequence: Synthetic oligonucleotide
uauuuucaaaaguguucacuu

SEQ ID NO: 32815 - RNA, 21 nt, Artificial Sequence
  Description of Artificial Sequence: Synthetic oligonucleotide
ucauuuucaaaaguguucauu

SEQ ID NO: 32816 - RNA, 21 nt, Artificial Sequence
  Description of Artificial Sequence: Synthetic oligonucleotide
uacauuuucaaaaguguucuu

SEQ ID NO: 32817 - RNA, 21 nt, Artificial Sequence
  Description of Artificial Sequence: Synthetic oligonucleotide
uuacauuuucaaaaguguuuu

SEQ ID NO: 32818 - RNA, 21 nt, Artificial Sequence
  Description of Artificial Sequence: Synthetic oligonucleotide
uguacauuuucaaaaguguuu

SEQ ID NO: 32819 - RNA, 21 nt, Artificial Sequence
  Description of Artificial Sequence: Synthetic oligonucleotide
uuguacauuuucaaaaguguu

SEQ ID NO: 32820 - RNA, 21 nt, Artificial Sequence
  Description of Artificial Sequence: Synthetic oligonucleotide
uauguacauuuucaaaaguuu

SEQ ID NO: 32821 - RNA, 21 nt, Artificial Sequence
  Description of Artificial Sequence: Synthetic oligonucleotide
ucauguacauuuucaaaaguu

SEQ ID NO: 32822 - RNA, 21 nt, Artificial Sequence
  Description of Artificial Sequence: Synthetic oligonucleotide
uacauguacauuuucaaaauu

SEQ ID NO: 32823 - RNA, 21 nt, Artificial Sequence
  Description of Artificial Sequence: Synthetic oligonucleotide
uaacauguacauuuucaaauu

SEQ ID NO: 32824 - RNA, 21 nt, Artificial Sequence
  Description of Artificial Sequence: Synthetic oligonucleotide
ugaacauguacauuuucaauu

SEQ ID NO: 32825 - RNA, 21 nt, Artificial Sequence
  Description of Artificial Sequence: Synthetic oligonucleotide
uggaacauguacauuuucauu

SEQ ID NO: 32826 - RNA, 21 nt, Artificial Sequence
  Description of Artificial Sequence: Synthetic oligonucleotide
uaggaacauguacauuuucuu

SEQ ID NO: 32827 - RNA, 21 nt, Artificial Sequence
  Description of Artificial Sequence: Synthetic oligonucleotide
uaaggaacauguacauuuuuu

SEQ ID NO: 32828 - RNA, 21 nt, Artificial Sequence
  Description of Artificial Sequence: Synthetic oligonucleotide
uaaaggaacauguacauuuuu

SEQ ID NO: 32829 - RNA, 21 nt, Artificial Sequence
  Description of Artificial Sequence: Synthetic oligonucleotide
ucaaaggaacauguacauuuu

SEQ ID NO: 32830 - RNA, 21 nt, Artificial Sequence
  Description of Artificial Sequence: Synthetic oligonucleotide
uacaaaggaacauguacauuu

SEQ ID NO: 32831 - RNA, 21 nt, Artificial Sequence
  Description of Artificial Sequence: Synthetic oligonucleotide
uuacaaaggaacauguacauu

SEQ ID NO: 32832 - RNA, 21 nt, Artificial Sequence
  Description of Artificial Sequence: Synthetic oligonucleotide
uuuacaaaggaacauguacuu

SEQ ID NO: 32833 - RNA, 21 nt, Artificial Sequence
  Description of Artificial Sequence: Synthetic oligonucleotide
uauuacaaaggaacauguauu

SEQ ID NO: 32834 - RNA, 21 nt, Artificial Sequence
  Description of Artificial Sequence: Synthetic oligonucleotide
uaauuacaaaggaacauguuu

SEQ ID NO: 32835 - RNA, 21 nt, Artificial Sequence
  Description of Artificial Sequence: Synthetic oligonucleotide
ucaauuacaaaggaacauguu

SEQ ID NO: 32836 - RNA, 21 nt, Artificial Sequence
  Description of Artificial Sequence: Synthetic oligonucleotide
uucaauuacaaaggaacauuu

SEQ ID NO: 32837 - RNA, 21 nt, Artificial Sequence
  Description of Artificial Sequence: Synthetic oligonucleotide
ugucaauuacaaaggaacauu

SEQ ID NO: 32838 - RNA, 21 nt, Artificial Sequence
  Description of Artificial Sequence: Synthetic oligonucleotide
uugucaauuacaaaggaacuu

SEQ ID NO: 32839 - RNA, 21 nt, Artificial Sequence
  Description of Artificial Sequence: Synthetic oligonucleotide
ugugucaauuacaaaggaauu

SEQ ID NO: 32840 - RNA, 21 nt, Artificial Sequence
  Description of Artificial Sequence: Synthetic oligonucleotide
uagugucaauuacaaaggauu

SEQ ID NO: 32841 - RNA, 21 nt, Artificial Sequence
  Description of Artificial Sequence: Synthetic oligonucleotide
uuagugucaauuacaaagguu

SEQ ID NO: 32842 - RNA, 21 nt, Artificial Sequence
  Description of Artificial Sequence: Synthetic oligonucleotide
uauagugucaauuacaaaguu

SEQ ID NO: 32843 - RNA, 21 nt, Artificial Sequence
  Description of Artificial Sequence: Synthetic oligonucleotide
uuauagugucaauuacaaauu

SEQ ID NO: 32844 - RNA, 21 nt, Artificial Sequence
  Description of Artificial Sequence: Synthetic oligonucleotide
uauauagugucaauuacaauu

SEQ ID NO: 32845 - RNA, 21 nt, Artificial Sequence
  Description of Artificial Sequence: Synthetic oligonucleotide
uuauauagugucaauuacauu

SEQ ID NO: 32846 - RNA, 21 nt, Artificial Sequence
  Description of Artificial Sequence: Synthetic oligonucleotide
uauauauagugucaauuacuu

SEQ ID NO: 32847 - RNA, 21 nt, Artificial Sequence
  Description of Artificial Sequence: Synthetic oligonucleotide
uaauauauagugucaauuauu

SEQ ID NO: 32848 - RNA, 21 nt, Artificial Sequence
  Description of Artificial Sequence: Synthetic oligonucleotide
uaaauauauagugucaauuuu

SEQ ID NO: 32849 - RNA, 21 nt, Artificial Sequence
  Description of Artificial Sequence: Synthetic oligonucleotide
ugaaauauauagugucaauuu

SEQ ID NO: 32850 - RNA, 21 nt, Artificial Sequence
  Description of Artificial Sequence: Synthetic oligonucleotide
uagaaauauauagugucaauu

SEQ ID NO: 32851 - RNA, 21 nt, Artificial Sequence
  Description of Artificial Sequence: Synthetic oligonucleotide
uaagaaauauauagugucauu

SEQ ID NO: 32852 - RNA, 21 nt, Artificial Sequence
  Description of Artificial Sequence: Synthetic oligonucleotide
uuaagaaauauauagugucuu

SEQ ID NO: 32853 - RNA, 21 nt, Artificial Sequence
  Description of Artificial Sequence: Synthetic oligonucleotide
uuuaagaaauauauaguguuu

SEQ ID NO: 32854 - RNA, 21 nt, Artificial Sequence
  Description of Artificial Sequence: Synthetic oligonucleotide
uauuaagaaauauauaguguu

SEQ ID NO: 32855 - RNA, 21 nt, Artificial Sequence
  Description of Artificial Sequence: Synthetic oligonucleotide
uuauuaagaaauauauaguuu

SEQ ID NO: 32856 - RNA, 21 nt, Artificial Sequence
  Description of Artificial Sequence: Synthetic oligonucleotide
uuuauuaagaaauauauaguu

SEQ ID NO: 32857 - RNA, 21 nt, Artificial Sequence
  Description of Artificial Sequence: Synthetic oligonucleotide
uuuuauuaagaaauauauauu

SEQ ID NO: 32858 - RNA, 21 nt, Artificial Sequence
  Description of Artificial Sequence: Synthetic oligonucleotide
uuuuuauuaagaaauauauuu

SEQ ID NO: 32859 - RNA, 21 nt, Artificial Sequence
  Description of Artificial Sequence: Synthetic oligonucleotide
uauuuuauuaagaaauauauu

SEQ ID NO: 32860 - RNA, 21 nt, Artificial Sequence
  Description of Artificial Sequence: Synthetic oligonucleotide
uuauuuuauuaagaaauauuu

SEQ ID NO: 32861 - RNA, 21 nt, Artificial Sequence
  Description of Artificial Sequence: Synthetic oligonucleotide
uuuauuuuauuaagaaauauu

SEQ ID NO: 32862 - RNA, 21 nt, Artificial Sequence
  Description of Artificial Sequence: Synthetic oligonucleotide
uauuauuuuauuaagaaauuu

SEQ ID NO: 32863 - RNA, 21 nt, Artificial Sequence
  Description of Artificial Sequence: Synthetic oligonucleotide
uaauuauuuuauuaagaaauu

SEQ ID NO: 32864 - RNA, 21 nt, Artificial Sequence
  Description of Artificial Sequence: Synthetic oligonucleotide
ugaauuauuuuauuaagaauu

SEQ ID NO: 32865 - RNA, 21 nt, Artificial Sequence
  Description of Artificial Sequence: Synthetic oligonucleotide
uagaauuauuuuauuaagauu

SEQ ID NO: 32866 - RNA, 21 nt, Artificial Sequence
  Description of Artificial Sequence: Synthetic oligonucleotide
ugagaauuauuuuauuaaguu

SEQ ID NO: 32867 - RNA, 21 nt, Artificial Sequence
  Description of Artificial Sequence: Synthetic oligonucleotide
uugagaauuauuuuauuaauu

SEQ ID NO: 32868 - RNA, 21 nt, Artificial Sequence
  Description of Artificial Sequence: Synthetic oligonucleotide
uuugagaauuauuuuauuauu

SEQ ID NO: 32869 - RNA, 21 nt, Artificial Sequence
  Description of Artificial Sequence: Synthetic oligonucleotide
uuuugagaauuauuuuauuuu

SEQ ID NO: 32870 - RNA, 21 nt, Artificial Sequence
  Description of Artificial Sequence: Synthetic oligonucleotide
uauuugagaauuauuuuauuu

SEQ ID NO: 32871 - RNA, 21 nt, Artificial Sequence
  Description of Artificial Sequence: Synthetic oligonucleotide
uaauuugagaauuauuuuauu

SEQ ID NO: 32872 - RNA, 21 nt, Artificial Sequence
  Description of Artificial Sequence: Synthetic oligonucleotide
uaaauuugagaauuauuuuuu

SEQ ID NO: 32873 - RNA, 21 nt, Artificial Sequence
  Description of Artificial Sequence: Synthetic oligonucleotide
ucaaauuugagaauuauuuuu

SEQ ID NO: 32874 - RNA, 21 nt, Artificial Sequence
  Description of Artificial Sequence: Synthetic oligonucleotide
uacaaauuugagaauuauuuu

SEQ ID NO: 32875 - RNA, 21 nt, Artificial Sequence
  Description of Artificial Sequence: Synthetic oligonucleotide
uaacaaauuugagaauuauuu

SEQ ID NO: 32876 - RNA, 21 nt, Artificial Sequence
  Description of Artificial Sequence: Synthetic oligonucleotide
uaaacaaauuugagaauuauu

SEQ ID NO: 32877 - RNA, 21 nt, Artificial Sequence
  Description of Artificial Sequence: Synthetic oligonucleotide
ugaaacaaauuugagaauuuu

SEQ ID NO: 32878 - RNA, 21 nt, Artificial Sequence
  Description of Artificial Sequence: Synthetic oligonucleotide
uagaaacaaauuugagaauuu

SEQ ID NO: 32879 - RNA, 21 nt, Artificial Sequence
  Description of Artificial Sequence: Synthetic oligonucleotide
uaagaaacaaauuugagaauu

SEQ ID NO: 32880 - RNA, 21 nt, Artificial Sequence
  Description of Artificial Sequence: Synthetic oligonucleotide
uuaagaaacaaauuugagauu

SEQ ID NO: 32881 - RNA, 21 nt, Artificial Sequence
  Description of Artificial Sequence: Synthetic oligonucleotide
uauaagaaacaaauuugaguu

SEQ ID NO: 32882 - RNA, 21 nt, Artificial Sequence
  Description of Artificial Sequence: Synthetic oligonucleotide
ucauaagaaacaaauuugauu

SEQ ID NO: 32883 - RNA, 21 nt, Artificial Sequence
  Description of Artificial Sequence: Synthetic oligonucleotide
uucauaagaaacaaauuuguu

SEQ ID NO: 32884 - RNA, 21 nt, Artificial Sequence
  Description of Artificial Sequence: Synthetic oligonucleotide
uuucauaagaaacaaauuuuu

SEQ ID NO: 32885 - RNA, 21 nt, Artificial Sequence
  Description of Artificial Sequence: Synthetic oligonucleotide
uauucauaagaaacaaauuuu

SEQ ID NO: 32886 - RNA, 21 nt, Artificial Sequence
  Description of Artificial Sequence: Synthetic oligonucleotide
ugauucauaagaaacaaauuu

SEQ ID NO: 32887 - RNA, 21 nt, Artificial Sequence
  Description of Artificial Sequence: Synthetic oligonucleotide
uugauucauaagaaacaaauu

SEQ ID NO: 32888 - RNA, 21 nt, Artificial Sequence
  Description of Artificial Sequence: Synthetic oligonucleotide
uaugauucauaagaaacaauu

SEQ ID NO: 32889 - RNA, 21 nt, Artificial Sequence
  Description of Artificial Sequence: Synthetic oligonucleotide
ugaugauucauaagaaacauu

SEQ ID NO: 32890 - RNA, 21 nt, Artificial Sequence
  Description of Artificial Sequence: Synthetic oligonucleotide
uagaugauucauaagaaacuu

SEQ ID NO: 32891 - RNA, 21 nt, Artificial Sequence
  Description of Artificial Sequence: Synthetic oligonucleotide
ugagaugauucauaagaaauu

SEQ ID NO: 32892 - RNA, 21 nt, Artificial Sequence
  Description of Artificial Sequence: Synthetic oligonucleotide
uagagaugauucauaagaauu

SEQ ID NO: 32893 - RNA, 21 nt, Artificial Sequence
  Description of Artificial Sequence: Synthetic oligonucleotide
ugagagaugauucauaagauu

SEQ ID NO: 32894 - RNA, 21 nt, Artificial Sequence
  Description of Artificial Sequence: Synthetic oligonucleotide
uugagagaugauucauaaguu

SEQ ID NO: 32895 - RNA, 21 nt, Artificial Sequence
  Description of Artificial Sequence: Synthetic oligonucleotide
uuugagagaugauucauaauu

SEQ ID NO: 32896 - RNA, 21 nt, Artificial Sequence
  Description of Artificial Sequence: Synthetic oligonucleotide
uuuugagagaugauucauauu

SEQ ID NO: 32897 - RNA, 21 nt, Artificial Sequence
  Description of Artificial Sequence: Synthetic oligonucleotide
uauuugagagaugauucauuu

SEQ ID NO: 32898 - RNA, 21 nt, Artificial Sequence
  Description of Artificial Sequence: Synthetic oligonucleotide
ugauuugagagaugauucauu

SEQ ID NO: 32899 - RNA, 21 nt, Artificial Sequence
  Description of Artificial Sequence: Synthetic oligonucleotide
uagauuugagagaugauucuu

SEQ ID NO: 32900 - RNA, 21 nt, Artificial Sequence
  Description of Artificial Sequence: Synthetic oligonucleotide
uuagauuugagagaugauuuu

SEQ ID NO: 32901 - RNA, 21 nt, Artificial Sequence
  Description of Artificial Sequence: Synthetic oligonucleotide
ucuagauuugagagaugauuu

SEQ ID NO: 32902 - RNA, 21 nt, Artificial Sequence
  Description of Artificial Sequence: Synthetic oligonucleotide
uacuagauuugagagaugauu

SEQ ID NO: 32903 - RNA, 21 nt, Artificial Sequence
  Description of Artificial Sequence: Synthetic oligonucleotide
uaacuagauuugagagauguu

SEQ ID NO: 32904 - RNA, 21 nt, Artificial Sequence
  Description of Artificial Sequence: Synthetic oligonucleotide
uuaacuagauuugagagauuu

SEQ ID NO: 32905 - RNA, 21 nt, Artificial Sequence
  Description of Artificial Sequence: Synthetic oligonucleotide
ucuaacuagauuugagagauu

SEQ ID NO: 32906 - RNA, 21 nt, Artificial Sequence
  Description of Artificial Sequence: Synthetic oligonucleotide
uucuaacuagauuugagaguu

SEQ ID NO: 32907 - RNA, 21 nt, Artificial Sequence
  Description of Artificial Sequence: Synthetic oligonucleotide
ugucuaacuagauuugagauu

SEQ ID NO: 32908 - RNA, 21 nt, Artificial Sequence
  Description of Artificial Sequence: Synthetic oligonucleotide
uugucuaacuagauuugaguu

SEQ ID NO: 32909 - RNA, 21 nt, Artificial Sequence
  Description of Artificial Sequence: Synthetic oligonucleotide
uuugucuaacuagauuugauu

SEQ ID NO: 32910 - RNA, 21 nt, Artificial Sequence
  Description of Artificial Sequence: Synthetic oligonucleotide
uauugucuaacuagauuuguu

SEQ ID NO: 32911 - RNA, 21 nt, Artificial Sequence
  Description of Artificial Sequence: Synthetic oligonucleotide
uaauugucuaacuagauuuuu

SEQ ID NO: 32912 - RNA, 21 nt, Artificial Sequence
  Description of Artificial Sequence: Synthetic oligonucleotide
uaaauugucuaacuagauuuu

SEQ ID NO: 32913 - RNA, 21 nt, Artificial Sequence
  Description of Artificial Sequence: Synthetic oligonucleotide
ucaaauugucuaacuagauuu

SEQ ID NO: 32914 - RNA, 21 nt, Artificial Sequence
  Description of Artificial Sequence: Synthetic oligonucleotide
ugcaaauugucuaacuagauu

SEQ ID NO: 32915 - RNA, 21 nt, Artificial Sequence
  Description of Artificial Sequence: Synthetic oligonucleotide
uugcaaauugucuaacuaguu

SEQ ID NO: 32916 - RNA, 21 nt, Artificial Sequence
  Description of Artificial Sequence: Synthetic oligonucleotide
ugugcaaauugucuaacuauu

SEQ ID NO: 32917 - RNA, 21 nt, Artificial Sequence
  Description of Artificial Sequence: Synthetic oligonucleotide
uugugcaaauugucuaacuuu

SEQ ID NO: 32918 - RNA, 21 nt, Artificial Sequence
  Description of Artificial Sequence: Synthetic oligonucleotide
ugugugcaaauugucuaacuu

SEQ ID NO: 32919 - RNA, 21 nt, Artificial Sequence
  Description of Artificial Sequence: Synthetic oligonucleotide
uugugugcaaauugucuaauu

SEQ ID NO: 32920 - RNA, 21 nt, Artificial Sequence
  Description of Artificial Sequence: Synthetic oligonucleotide
uaugugugcaaauugucuauu

SEQ ID NO: 32921 - RNA, 21 nt, Artificial Sequence
  Description of Artificial Sequence: Synthetic oligonucleotide
uuaugugugcaaauugucuuu

SEQ ID NO: 32922 - RNA, 21 nt, Artificial Sequence
  Description of Artificial Sequence: Synthetic oligonucleotide
uguaugugugcaaauugucuu

SEQ ID NO: 32923 - RNA, 21 nt, Artificial Sequence
  Description of Artificial Sequence: Synthetic oligonucleotide
uaguaugugugcaaauuguuu

SEQ ID NO: 32924 - RNA, 21 nt, Artificial Sequence
  Description of Artificial Sequence: Synthetic oligonucleotide
uaaguaugugugcaaauuguu

SEQ ID NO: 32925 - RNA, 21 nt, Artificial Sequence
  Description of Artificial Sequence: Synthetic oligonucleotide
uaaaguaugugugcaaauuuu

SEQ ID NO: 32926 - RNA, 21 nt, Artificial Sequence
  Description of Artificial Sequence: Synthetic oligonucleotide
uaaaaguaugugugcaaauuu

SEQ ID NO: 32927 - RNA, 21 nt, Artificial Sequence
  Description of Artificial Sequence: Synthetic oligonucleotide
ugaaaaguaugugugcaaauu

SEQ ID NO: 32928 - RNA, 21 nt, Artificial Sequence
  Description of Artificial Sequence: Synthetic oligonucleotide
uagaaaaguaugugugcaauu

SEQ ID NO: 32929 - RNA, 21 nt, Artificial Sequence
  Description of Artificial Sequence: Synthetic oligonucleotide
uuagaaaaguaugugugcauu

SEQ ID NO: 32930 - RNA, 21 nt, Artificial Sequence
  Description of Artificial Sequence: Synthetic oligonucleotide
uuuagaaaaguaugugugcuu

SEQ ID NO: 32931 - RNA, 21 nt, Artificial Sequence
  Description of Artificial Sequence: Synthetic oligonucleotide
ucuuagaaaaguauguguguu

SEQ ID NO: 32932 - RNA, 21 nt, Artificial Sequence
  Description of Artificial Sequence: Synthetic oligonucleotide
uccuuagaaaaguauguguuu

SEQ ID NO: 32933 - RNA, 21 nt, Artificial Sequence
  Description of Artificial Sequence: Synthetic oligonucleotide
ucccuuagaaaaguauguguu

SEQ ID NO: 32934 - RNA, 21 nt, Artificial Sequence
  Description of Artificial Sequence: Synthetic oligonucleotide
uucccuuagaaaaguauguuu

SEQ ID NO: 32935 - RNA, 21 nt, Artificial Sequence
  Description of Artificial Sequence: Synthetic oligonucleotide
ugucccuuagaaaaguauguu

SEQ ID NO: 32936 - RNA, 21 nt, Artificial Sequence
  Description of Artificial Sequence: Synthetic oligonucleotide
uugucccuuagaaaaguauuu

SEQ ID NO: 32937 - RNA, 21 nt, Artificial Sequence
  Description of Artificial Sequence: Synthetic oligonucleotide
uaugucccuuagaaaaguauu

SEQ ID NO: 32938 - RNA, 21 nt, Artificial Sequence
  Description of Artificial Sequence: Synthetic oligonucleotide
uaaugucccuuagaaaaguuu

SEQ ID NO: 32939 - RNA, 21 nt, Artificial Sequence
  Description of Artificial Sequence: Synthetic oligonucleotide
uuaaugucccuuagaaaaguu

SEQ ID NO: 32940 - RNA, 21 nt, Artificial Sequence
  Description of Artificial Sequence: Synthetic oligonucleotide
uauaaugucccuuagaaaauu

SEQ ID NO: 32941 - RNA, 21 nt, Artificial Sequence
  Description of Artificial Sequence: Synthetic oligonucleotide
ugauaaugucccuuagaaauu

SEQ ID NO: 32942 - RNA, 21 nt, Artificial Sequence
  Description of Artificial Sequence: Synthetic oligonucleotide
uagauaaugucccuuagaauu

SEQ ID NO: 32943 - RNA, 21 nt, Artificial Sequence
  Description of Artificial Sequence: Synthetic oligonucleotide
uaagauaaugucccuuagauu

SEQ ID NO: 32944 - RNA, 21 nt, Artificial Sequence
  Description of Artificial Sequence: Synthetic oligonucleotide
ugaagauaaugucccuuaguu

SEQ ID NO: 32945 - RNA, 21 nt, Artificial Sequence
  Description of Artificial Sequence: Synthetic oligonucleotide
uggaagauaaugucccuuauu

SEQ ID NO: 32946 - RNA, 21 nt, Artificial Sequence
  Description of Artificial Sequence: Synthetic oligonucleotide
uaggaagauaaugucccuuuu

SEQ ID NO: 32947 - RNA, 21 nt, Artificial Sequence
  Description of Artificial Sequence: Synthetic oligonucleotide
uaaggaagauaaugucccuuu

SEQ ID NO: 32948 - RNA, 21 nt, Artificial Sequence
  Description of Artificial Sequence: Synthetic oligonucleotide
ugaaggaagauaaugucccuu

SEQ ID NO: 32949 - RNA, 21 nt, Artificial Sequence
  Description of Artificial Sequence: Synthetic oligonucleotide
uugaaggaagauaauguccuu

SEQ ID NO: 32950 - RNA, 21 nt, Artificial Sequence
  Description of Artificial Sequence: Synthetic oligonucleotide
ucugaaggaagauaaugucuu

SEQ ID NO: 32951 - RNA, 21 nt, Artificial Sequence
  Description of Artificial Sequence: Synthetic oligonucleotide
uccugaaggaagauaauguuu

SEQ ID NO: 32952 - RNA, 21 nt, Artificial Sequence
  Description of Artificial Sequence: Synthetic oligonucleotide
uaccugaaggaagauaauguu

SEQ ID NO: 32953 - RNA, 21 nt, Artificial Sequence
  Description of Artificial Sequence: Synthetic oligonucleotide
uaaccugaaggaagauaauuu

SEQ ID NO: 32954 - RNA, 21 nt, Artificial Sequence
  Description of Artificial Sequence: Synthetic oligonucleotide
uaaaccugaaggaagauaauu

SEQ ID NO: 32955 - RNA, 21 nt, Artificial Sequence
  Description of Artificial Sequence: Synthetic oligonucleotide
uaaaaccugaaggaagauauu

SEQ ID NO: 32956 - RNA, 21 nt, Artificial Sequence
  Description of Artificial Sequence: Synthetic oligonucleotide
uaaaaaccugaaggaagauuu

SEQ ID NO: 32957 - RNA, 21 nt, Artificial Sequence
  Description of Artificial Sequence: Synthetic oligonucleotide
uuaaaaaccugaaggaagauu

SEQ ID NO: 32958 - RNA, 21 nt, Artificial Sequence
  Description of Artificial Sequence: Synthetic oligonucleotide
uguaaaaaccugaaggaaguu

SEQ ID NO: 32959 - RNA, 21 nt, Artificial Sequence
  Description of Artificial Sequence: Synthetic oligonucleotide
ugguaaaaaccugaaggaauu

SEQ ID NO: 32960 - RNA, 21 nt, Artificial Sequence
  Description of Artificial Sequence: Synthetic oligonucleotide
uagguaaaaaccugaaggauu

SEQ ID NO: 32961 - RNA, 21 nt, Artificial Sequence
  Description of Artificial Sequence: Synthetic oligonucleotide
ugagguaaaaaccugaagguu

SEQ ID NO: 32962 - RNA, 21 nt, Artificial Sequence
  Description of Artificial Sequence: Synthetic oligonucleotide
uggagguaaaaaccugaaguu

SEQ ID NO: 32963 - RNA, 21 nt, Artificial Sequence
  Description of Artificial Sequence: Synthetic oligonucleotide
uuggagguaaaaaccugaauu

SEQ ID NO: 32964 - RNA, 21 nt, Artificial Sequence
  Description of Artificial Sequence: Synthetic oligonucleotide
uguggagguaaaaaccugauu

SEQ ID NO: 32965 - RNA, 21 nt, Artificial Sequence
  Description of Artificial Sequence: Synthetic oligonucleotide
uaguggagguaaaaaccuguu

SEQ ID NO: 32966 - RNA, 21 nt, Artificial Sequence
  Description of Artificial Sequence: Synthetic oligonucleotide
ugaguggagguaaaaaccuuu

SEQ ID NO: 32967 - RNA, 21 nt, Artificial Sequence
  Description of Artificial Sequence: Synthetic oligonucleotide
uugaguggagguaaaaaccuu

SEQ ID NO: 32968 - RNA, 21 nt, Artificial Sequence
  Description of Artificial Sequence: Synthetic oligonucleotide
uaugaguggagguaaaaacuu

SEQ ID NO: 32969 - RNA, 21 nt, Artificial Sequence
  Description of Artificial Sequence: Synthetic oligonucleotide
ugaugaguggagguaaaaauu

SEQ ID NO: 32970 - RNA, 21 nt, Artificial Sequence
  Description of Artificial Sequence: Synthetic oligonucleotide
uggaugaguggagguaaaauu

SEQ ID NO: 32971 - RNA, 21 nt, Artificial Sequence
  Description of Artificial Sequence: Synthetic oligonucleotide
uaggaugaguggagguaaauu

SEQ ID NO: 32972 - RNA, 21 nt, Artificial Sequence
  Description of Artificial Sequence: Synthetic oligonucleotide
uaaggaugaguggagguaauu

SEQ ID NO: 32973 - RNA, 21 nt, Artificial Sequence
  Description of Artificial Sequence: Synthetic oligonucleotide
uuaaggaugaguggagguauu

SEQ ID NO: 32974 - RNA, 21 nt, Artificial Sequence
  Description of Artificial Sequence: Synthetic oligonucleotide
ucuaaggaugaguggagguuu

SEQ ID NO: 32975 - RNA, 21 nt, Artificial Sequence
  Description of Artificial Sequence: Synthetic oligonucleotide
uucuaaggaugaguggagguu

SEQ ID NO: 32976 - RNA, 21 nt, Artificial Sequence
  Description of Artificial Sequence: Synthetic oligonucleotide
ucucuaaggaugaguggaguu

SEQ ID NO: 32977 - RNA, 21 nt, Artificial Sequence
  Description of Artificial Sequence: Synthetic oligonucleotide
ugcucuaaggaugaguggauu

SEQ ID NO: 32978 - RNA, 21 nt, Artificial Sequence
  Description of Artificial Sequence: Synthetic oligonucleotide
uggcucuaaggaugagugguu

SEQ ID NO: 32979 - RNA, 21 nt, Artificial Sequence
  Description of Artificial Sequence: Synthetic oligonucleotide
ugggcucuaaggaugaguguu

SEQ ID NO: 32980 - RNA, 21 nt, Artificial Sequence
  Description of Artificial Sequence: Synthetic oligonucleotide
uugggcucuaaggaugaguuu

SEQ ID NO: 32981 - RNA, 21 nt, Artificial Sequence
  Description of Artificial Sequence: Synthetic oligonucleotide
ugugggcucuaaggaugaguu

SEQ ID NO: 32982 - RNA, 21 nt, Artificial Sequence
  Description of Artificial Sequence: Synthetic oligonucleotide
uagugggcucuaaggaugauu

SEQ ID NO: 32983 - RNA, 21 nt, Artificial Sequence
  Description of Artificial Sequence: Synthetic oligonucleotide
ucagugggcucuaaggauguu

SEQ ID NO: 32984 - RNA, 21 nt, Artificial Sequence
  Description of Artificial Sequence: Synthetic oligonucleotide
uucagugggcucuaaggauuu

SEQ ID NO: 32985 - RNA, 21 nt, Artificial Sequence
  Description of Artificial Sequence: Synthetic oligonucleotide
ugucagugggcucuaaggauu

SEQ ID NO: 32986 - RNA, 21 nt, Artificial Sequence
  Description of Artificial Sequence: Synthetic oligonucleotide
uagucagugggcucuaagguu

SEQ ID NO: 32987 - RNA, 21 nt, Artificial Sequence
  Description of Artificial Sequence: Synthetic oligonucleotide
ucagucagugggcucuaaguu

SEQ ID NO: 32988 - RNA, 21 nt, Artificial Sequence
  Description of Artificial Sequence: Synthetic oligonucleotide
ugcagucagugggcucuaauu

SEQ ID NO: 32989 - RNA, 21 nt, Artificial Sequence
  Description of Artificial Sequence: Synthetic oligonucleotide
uagcagucagugggcucuauu

SEQ ID NO: 32990 - RNA, 21 nt, Artificial Sequence
  Description of Artificial Sequence: Synthetic oligonucleotide
ugagcagucagugggcucuuu

SEQ ID NO: 32991 - RNA, 21 nt, Artificial Sequence
  Description of Artificial Sequence: Synthetic oligonucleotide
uggagcagucagugggcucuu

SEQ ID NO: 32992 - RNA, 21 nt, Artificial Sequence
  Description of Artificial Sequence: Synthetic oligonucleotide
ugggagcagucagugggcuuu

SEQ ID NO: 32993 - RNA, 21 nt, Artificial Sequence
  Description of Artificial Sequence: Synthetic oligonucleotide
uggggagcagucagugggcuu

SEQ ID NO: 32994 - RNA, 21 nt, Artificial Sequence
  Description of Artificial Sequence: Synthetic oligonucleotide
uaggggagcagucaguggguu

SEQ ID NO: 32995 - RNA, 21 nt, Artificial Sequence
  Description of Artificial Sequence: Synthetic oligonucleotide
uaaggggagcagucagugguu

SEQ ID NO: 32996 - RNA, 21 nt, Artificial Sequence
  Description of Artificial Sequence: Synthetic oligonucleotide
uaaaggggagcagucaguguu

SEQ ID NO: 32997 - RNA, 21 nt, Artificial Sequence
  Description of Artificial Sequence: Synthetic oligonucleotide
uuaaaggggagcagucaguuu

SEQ ID NO: 32998 - RNA, 21 nt, Artificial Sequence
  Description of Artificial Sequence: Synthetic oligonucleotide
uauaaaggggagcagucaguu

SEQ ID NO: 32999 - RNA, 21 nt, Artificial Sequence
  Description of Artificial Sequence: Synthetic oligonucleotide
uuauaaaggggagcagucauu

SEQ ID NO: 33000 - RNA, 21 nt, Artificial Sequence
  Description of Artificial Sequence: Synthetic oligonucleotide
uguauaaaggggagcagucuu

SEQ ID NO: 33001 - RNA, 21 nt, Artificial Sequence
  Description of Artificial Sequence: Synthetic oligonucleotide
ugguauaaaggggagcaguuu

SEQ ID NO: 33002 - RNA, 21 nt, Artificial Sequence
  Description of Artificial Sequence: Synthetic oligonucleotide
uagguauaaaggggagcaguu

SEQ ID NO: 33003 - RNA, 21 nt, Artificial Sequence
  Description of Artificial Sequence: Synthetic oligonucleotide
ucagguauaaaggggagcauu

SEQ ID NO: 33004 - RNA, 21 nt, Artificial Sequence
  Description of Artificial Sequence: Synthetic oligonucleotide
uacagguauaaaggggagcuu

SEQ ID NO: 33005 - RNA, 21 nt, Artificial Sequence
  Description of Artificial Sequence: Synthetic oligonucleotide
uaacagguauaaaggggaguu

SEQ ID NO: 33006 - RNA, 21 nt, Artificial Sequence
  Description of Artificial Sequence: Synthetic oligonucleotide
ucaacagguauaaaggggauu

SEQ ID NO: 33007 - RNA, 21 nt, Artificial Sequence
  Description of Artificial Sequence: Synthetic oligonucleotide
uccaacagguauaaagggguu

SEQ ID NO: 33008 - RNA, 21 nt, Artificial Sequence
  Description of Artificial Sequence: Synthetic oligonucleotide
ugccaacagguauaaaggguu

SEQ ID NO: 33009 - RNA, 21 nt, Artificial Sequence
  Description of Artificial Sequence: Synthetic oligonucleotide
uggccaacagguauaaagguu

SEQ ID NO: 33010 - RNA, 21 nt, Artificial Sequence
  Description of Artificial Sequence: Synthetic oligonucleotide
ugggccaacagguauaaaguu

SEQ ID NO: 33011 - RNA, 21 nt, Artificial Sequence
  Description of Artificial Sequence: Synthetic oligonucleotide
uagggccaacagguauaaauu

SEQ ID NO: 33012 - RNA, 21 nt, Artificial Sequence
  Description of Artificial Sequence: Synthetic oligonucleotide
ucagggccaacagguauaauu

SEQ ID NO: 33013 - RNA, 21 nt, Artificial Sequence
  Description of Artificial Sequence: Synthetic oligonucleotide
ugcagggccaacagguauauu

SEQ ID NO: 33014 - RNA, 21 nt, Artificial Sequence
  Description of Artificial Sequence: Synthetic oligonucleotide
uggcagggccaacagguauuu

SEQ ID NO: 33015 - RNA, 21 nt, Artificial Sequence
  Description of Artificial Sequence: Synthetic oligonucleotide
uaggcagggccaacagguauu

SEQ ID NO: 33016 - RNA, 21 nt, Artificial Sequence
  Description of Artificial Sequence: Synthetic oligonucleotide
uuaggcagggccaacagguuu

SEQ ID NO: 33017 - RNA, 21 nt, Artificial Sequence
  Description of Artificial Sequence: Synthetic oligonucleotide
uauaggcagggccaacagguu

SEQ ID NO: 33018 - RNA, 21 nt, Artificial Sequence
  Description of Artificial Sequence: Synthetic oligonucleotide
uuauaggcagggccaacaguu

SEQ ID NO: 33019 - RNA, 21 nt, Artificial Sequence
  Description of Artificial Sequence: Synthetic oligonucleotide
ucuauaggcagggccaacauu

SEQ ID NO: 33020 - RNA, 21 nt, Artificial Sequence
  Description of Artificial Sequence: Synthetic oligonucleotide
uccuauaggcagggccaacuu

SEQ ID NO: 33021 - RNA, 21 nt, Artificial Sequence
  Description of Artificial Sequence: Synthetic oligonucleotide
uuccuauaggcagggccaauu

SEQ ID NO: 33022 - RNA, 21 nt, Artificial Sequence
  Description of Artificial Sequence: Synthetic oligonucleotide
ucuccuauaggcagggccauu

SEQ ID NO: 33023 - RNA, 21 nt, Artificial Sequence
  Description of Artificial Sequence: Synthetic oligonucleotide
uucuccuauaggcagggccuu

SEQ ID NO: 33024 - RNA, 21 nt, Artificial Sequence
  Description of Artificial Sequence: Synthetic oligonucleotide
ucucuccuauaggcagggcuu

SEQ ID NO: 33025 - RNA, 21 nt, Artificial Sequence
  Description of Artificial Sequence: Synthetic oligonucleotide
uucucuccuauaggcaggguu

SEQ ID NO: 33026 - RNA, 21 nt, Artificial Sequence
  Description of Artificial Sequence: Synthetic oligonucleotide
uuucucuccuauaggcagguu

SEQ ID NO: 33027 - RNA, 21 nt, Artificial Sequence
  Description of Artificial Sequence: Synthetic oligonucleotide
uauucucuccuauaggcaguu

SEQ ID NO: 33028 - RNA, 21 nt, Artificial Sequence
  Description of Artificial Sequence: Synthetic oligonucleotide
uuauucucuccuauaggcauu

SEQ ID NO: 33029 - RNA, 21 nt, Artificial Sequence
  Description of Artificial Sequence: Synthetic oligonucleotide
uauauucucuccuauaggcuu

SEQ ID NO: 33030 - RNA, 21 nt, Artificial Sequence
  Description of Artificial Sequence: Synthetic oligonucleotide
uaauauucucuccuauagguu

SEQ ID NO: 33031 - RNA, 21 nt, Artificial Sequence
  Description of Artificial Sequence: Synthetic oligonucleotide
uaaauauucucuccuauaguu

SEQ ID NO: 33032 - RNA, 21 nt, Artificial Sequence
  Description of Artificial Sequence: Synthetic oligonucleotide
ucaaauauucucuccuauauu

SEQ ID NO: 33033 - RNA, 21 nt, Artificial Sequence
  Description of Artificial Sequence: Synthetic oligonucleotide
uccaaauauucucuccuauuu

SEQ ID NO: 33034 - RNA, 21 nt, Artificial Sequence
  Description of Artificial Sequence: Synthetic oligonucleotide
uuccaaauauucucuccuauu

SEQ ID NO: 33035 - RNA, 21 nt, Artificial Sequence
  Description of Artificial Sequence: Synthetic oligonucleotide
ucuccaaauauucucuccuuu

SEQ ID NO: 33036 - RNA, 21 nt, Artificial Sequence
  Description of Artificial Sequence: Synthetic oligonucleotide
uucuccaaauauucucuccuu

SEQ ID NO: 33037 - RNA, 21 nt, Artificial Sequence
  Description of Artificial Sequence: Synthetic oligonucleotide
uaucuccaaauauucucucuu

SEQ ID NO: 33038 - RNA, 21 nt, Artificial Sequence
  Description of Artificial Sequence: Synthetic oligonucleotide
uuaucuccaaauauucucuuu

SEQ ID NO: 33039 - RNA, 21 nt, Artificial Sequence
  Description of Artificial Sequence: Synthetic oligonucleotide
ucuaucuccaaauauucucuu

SEQ ID NO: 33040 - RNA, 21 nt, Artificial Sequence
  Description of Artificial Sequence: Synthetic oligonucleotide
uccuaucuccaaauauucuuu

SEQ ID NO: 33041 - RNA, 21 nt, Artificial Sequence
  Description of Artificial Sequence: Synthetic oligonucleotide
ugccuaucuccaaauauucuu

SEQ ID NO: 33042 - RNA, 21 nt, Artificial Sequence
  Description of Artificial Sequence: Synthetic oligonucleotide
uugccuaucuccaaauauuuu

SEQ ID NO: 33043 - RNA, 21 nt, Artificial Sequence
  Description of Artificial Sequence: Synthetic oligonucleotide
ucugccuaucuccaaauauuu

SEQ ID NO: 33044 - RNA, 21 nt, Artificial Sequence
  Description of Artificial Sequence: Synthetic oligonucleotide
ugcugccuaucuccaaauauu

SEQ ID NO: 33045 - RNA, 21 nt, Artificial Sequence
  Description of Artificial Sequence: Synthetic oligonucleotide
uagcugccuaucuccaaauuu

SEQ ID NO: 33046 - RNA, 21 nt, Artificial Sequence
  Description of Artificial Sequence: Synthetic oligonucleotide
uaagcugccuaucuccaaauu

SEQ ID NO: 33047 - RNA, 21 nt, Artificial Sequence
  Description of Artificial Sequence: Synthetic oligonucleotide
ugaagcugccuaucuccaauu

SEQ ID NO: 33048 - RNA, 21 nt, Artificial Sequence
  Description of Artificial Sequence: Synthetic oligonucleotide
uugaagcugccuaucuccauu

SEQ ID NO: 33049 - RNA, 21 nt, Artificial Sequence
  Description of Artificial Sequence: Synthetic oligonucleotide
ucugaagcugccuaucuccuu

SEQ ID NO: 33050 - RNA, 21 nt, Artificial Sequence
  Description of Artificial Sequence: Synthetic oligonucleotide
uccugaagcugccuaucucuu

SEQ ID NO: 33051 - RNA, 21 nt, Artificial Sequence
  Description of Artificial Sequence: Synthetic oligonucleotide
uuccugaagcugccuaucuuu

SEQ ID NO: 33052 - RNA, 21 nt, Artificial Sequence
  Description of Artificial Sequence: Synthetic oligonucleotide
uauccugaagcugccuaucuu

SEQ ID NO: 33053 - RNA, 21 nt, Artificial Sequence
  Description of Artificial Sequence: Synthetic oligonucleotide
ucauccugaagcugccuauuu

SEQ ID NO: 33054 - RNA, 21 nt, Artificial Sequence
  Description of Artificial Sequence: Synthetic oligonucleotide
ugcauccugaagcugccuauu

SEQ ID NO: 33055 - RNA, 21 nt, Artificial Sequence
  Description of Artificial Sequence: Synthetic oligonucleotide
uugcauccugaagcugccuuu

SEQ ID NO: 33056 - RNA, 21 nt, Artificial Sequence
  Description of Artificial Sequence: Synthetic oligonucleotide
uaugcauccugaagcugccuu

SEQ ID NO: 33057 - RNA, 21 nt, Artificial Sequence
  Description of Artificial Sequence: Synthetic oligonucleotide
uaaugcauccugaagcugcuu

SEQ ID NO: 33058 - RNA, 21 nt, Artificial Sequence
  Description of Artificial Sequence: Synthetic oligonucleotide
ucaaugcauccugaagcuguu

SEQ ID NO: 33059 - RNA, 21 nt, Artificial Sequence
  Description of Artificial Sequence: Synthetic oligonucleotide
ugcaaugcauccugaagcuuu

SEQ ID NO: 33060 - RNA, 21 nt, Artificial Sequence
  Description of Artificial Sequence: Synthetic oligonucleotide
uugcaaugcauccugaagcuu

SEQ ID NO: 33061 - RNA, 21 nt, Artificial Sequence
  Description of Artificial Sequence: Synthetic oligonucleotide
uuugcaaugcauccugaaguu

SEQ ID NO: 33062 - RNA, 21 nt, Artificial Sequence
  Description of Artificial Sequence: Synthetic oligonucleotide
uauugcaaugcauccugaauu

SEQ ID NO: 33063 - RNA, 21 nt, Artificial Sequence
  Description of Artificial Sequence: Synthetic oligonucleotide
ugauugcaaugcauccugauu

SEQ ID NO: 33064 - RNA, 21 nt, Artificial Sequence
  Description of Artificial Sequence: Synthetic oligonucleotide
uugauugcaaugcauccuguu

SEQ ID NO: 33065 - RNA, 21 nt, Artificial Sequence
  Description of Artificial Sequence: Synthetic oligonucleotide
uaugauugcaaugcauccuuu

SEQ ID NO: 33066 - RNA, 21 nt, Artificial Sequence
  Description of Artificial Sequence: Synthetic oligonucleotide
ugaugauugcaaugcauccuu

SEQ ID NO: 33067 - RNA, 21 nt, Artificial Sequence
  Description of Artificial Sequence: Synthetic oligonucleotide
uggaugauugcaaugcaucuu

SEQ ID NO: 33068 - RNA, 21 nt, Artificial Sequence
  Description of Artificial Sequence: Synthetic oligonucleotide
uaggaugauugcaaugcauuu

SEQ ID NO: 33069 - RNA, 21 nt, Artificial Sequence
  Description of Artificial Sequence: Synthetic oligonucleotide
uaaggaugauugcaaugcauu

SEQ ID NO: 33070 - RNA, 21 nt, Artificial Sequence
  Description of Artificial Sequence: Synthetic oligonucleotide
uaaaggaugauugcaaugcuu

SEQ ID NO: 33071 - RNA, 21 nt, Artificial Sequence
  Description of Artificial Sequence: Synthetic oligonucleotide
uaaaaggaugauugcaauguu

SEQ ID NO: 33072 - RNA, 21 nt, Artificial Sequence
  Description of Artificial Sequence: Synthetic oligonucleotide
ugaaaaggaugauugcaauuu

SEQ ID NO: 33073 - RNA, 21 nt, Artificial Sequence
  Description of Artificial Sequence: Synthetic oligonucleotide
uagaaaaggaugauugcaauu

SEQ ID NO: 33074 - RNA, 21 nt, Artificial Sequence
  Description of Artificial Sequence: Synthetic oligonucleotide
uaagaaaaggaugauugcauu

SEQ ID NO: 33075 - RNA, 21 nt, Artificial Sequence
  Description of Artificial Sequence: Synthetic oligonucleotide
uuaagaaaaggaugauugcuu

SEQ ID NO: 33076 - RNA, 21 nt, Artificial Sequence
  Description of Artificial Sequence: Synthetic oligonucleotide
uuuaagaaaaggaugauuguu

SEQ ID NO: 33077 - RNA, 21 nt, Artificial Sequence
  Description of Artificial Sequence: Synthetic oligonucleotide
uuuuaagaaaaggaugauuuu

SEQ ID NO: 33078 - RNA, 21 nt, Artificial Sequence
  Description of Artificial Sequence: Synthetic oligonucleotide
uauuuaagaaaaggaugauuu

SEQ ID NO: 33079 - RNA, 21 nt, Artificial Sequence
  Description of Artificial Sequence: Synthetic oligonucleotide
uaauuuaagaaaaggaugauu

SEQ ID NO: 33080 - RNA, 21 nt, Artificial Sequence
  Description of Artificial Sequence: Synthetic oligonucleotide
uuaauuuaagaaaaggauguu

SEQ ID NO: 33081 - RNA, 21 nt, Artificial Sequence
  Description of Artificial Sequence: Synthetic oligonucleotide
uauaauuuaagaaaaggauuu

SEQ ID NO: 33082 - RNA, 21 nt, Artificial Sequence
  Description of Artificial Sequence: Synthetic oligonucleotide
ucauaauuuaagaaaaggauu

SEQ ID NO: 33083 - RNA, 21 nt, Artificial Sequence
  Description of Artificial Sequence: Synthetic oligonucleotide
uacauaauuuaagaaaagguu

SEQ ID NO: 33084 - RNA, 21 nt, Artificial Sequence
  Description of Artificial Sequence: Synthetic oligonucleotide
ugacauaauuuaagaaaaguu

SEQ ID NO: 33085 - RNA, 21 nt, Artificial Sequence
  Description of Artificial Sequence: Synthetic oligonucleotide
uugacauaauuuaagaaaauu

SEQ ID NO: 33086 - RNA, 21 nt, Artificial Sequence
  Description of Artificial Sequence: Synthetic oligonucleotide
ugugacauaauuuaagaaauu

SEQ ID NO: 33087 - RNA, 21 nt, Artificial Sequence
  Description of Artificial Sequence: Synthetic oligonucleotide
uagugacauaauuuaagaauu

SEQ ID NO: 33088 - RNA, 21 nt, Artificial Sequence
  Description of Artificial Sequence: Synthetic oligonucleotide
uuagugacauaauuuaagauu

SEQ ID NO: 33089 - RNA, 21 nt, Artificial Sequence
  Description of Artificial Sequence: Synthetic oligonucleotide
ucuagugacauaauuuaaguu

SEQ ID NO: 33090 - RNA, 21 nt, Artificial Sequence
  Description of Artificial Sequence: Synthetic oligonucleotide
uacuagugacauaauuuaauu

SEQ ID NO: 33091 - RNA, 21 nt, Artificial Sequence
  Description of Artificial Sequence: Synthetic oligonucleotide
ugacuagugacauaauuuauu

SEQ ID NO: 33092 - RNA, 21 nt, Artificial Sequence
  Description of Artificial Sequence: Synthetic oligonucleotide
uagacuagugacauaauuuuu

SEQ ID NO: 33093 - RNA, 21 nt, Artificial Sequence
  Description of Artificial Sequence: Synthetic oligonucleotide
uaagacuagugacauaauuuu

SEQ ID NO: 33094 - RNA, 21 nt, Artificial Sequence
  Description of Artificial Sequence: Synthetic oligonucleotide
uaaagacuagugacauaauuu

SEQ ID NO: 33095 - RNA, 21 nt, Artificial Sequence
  Description of Artificial Sequence: Synthetic oligonucleotide
uaaaagacuagugacauaauu

SEQ ID NO: 33096 - RNA, 21 nt, Artificial Sequence
  Description of Artificial Sequence: Synthetic oligonucleotide
uuaaaagacuagugacauauu

SEQ ID NO: 33097 - RNA, 21 nt, Artificial Sequence
  Description of Artificial Sequence: Synthetic oligonucleotide
uauaaaagacuagugacauuu

SEQ ID NO: 33098 - RNA, 21 nt, Artificial Sequence
  Description of Artificial Sequence: Synthetic oligonucleotide
uaauaaaagacuagugacauu

SEQ ID NO: 33099 - RNA, 21 nt, Artificial Sequence
  Description of Artificial Sequence: Synthetic oligonucleotide
uaaauaaaagacuagugacuu

SEQ ID NO: 33100 - RNA, 21 nt, Artificial Sequence
  Description of Artificial Sequence: Synthetic oligonucleotide
uaaaauaaaagacuagugauu

SEQ ID NO: 33101 - RNA, 21 nt, Artificial Sequence
  Description of Artificial Sequence: Synthetic oligonucleotide
uaaaaauaaaagacuaguguu

SEQ ID NO: 33102 - RNA, 21 nt, Artificial Sequence
  Description of Artificial Sequence: Synthetic oligonucleotide
uaaaaaauaaaagacuaguuu

SEQ ID NO: 33103 - RNA, 21 nt, Artificial Sequence
  Description of Artificial Sequence: Synthetic oligonucleotide
ugaaaaaauaaaagacuaguu

SEQ ID NO: 33104 - RNA, 21 nt, Artificial Sequence
  Description of Artificial Sequence: Synthetic oligonucleotide
uggaaaaaauaaaagacuauu

SEQ ID NO: 33105 - RNA, 21 nt, Artificial Sequence
  Description of Artificial Sequence: Synthetic oligonucleotide
ugggaaaaaauaaaagacuuu

SEQ ID NO: 33106 - RNA, 21 nt, Artificial Sequence
  Description of Artificial Sequence: Synthetic oligonucleotide
uggggaaaaaauaaaagacuu

SEQ ID NO: 33107 - RNA, 21 nt, Artificial Sequence
  Description of Artificial Sequence: Synthetic oligonucleotide
uaggggaaaaaauaaaagauu

SEQ ID NO: 33108 - RNA, 21 nt, Artificial Sequence
  Description of Artificial Sequence: Synthetic oligonucleotide
ugaggggaaaaaauaaaaguu

SEQ ID NO: 33109 - RNA, 21 nt, Artificial Sequence
  Description of Artificial Sequence: Synthetic oligonucleotide
uagaggggaaaaaauaaaauu

SEQ ID NO: 33110 - RNA, 21 nt, Artificial Sequence
  Description of Artificial Sequence: Synthetic oligonucleotide
uaagaggggaaaaaauaaauu

SEQ ID NO: 33111 - RNA, 21 nt, Artificial Sequence
  Description of Artificial Sequence: Synthetic oligonucleotide
ucaagaggggaaaaaauaauu

SEQ ID NO: 33112 - RNA, 21 nt, Artificial Sequence
  Description of Artificial Sequence: Synthetic oligonucleotide
uucaagaggggaaaaaauauu

SEQ ID NO: 33113 - RNA, 21 nt, Artificial Sequence
  Description of Artificial Sequence: Synthetic oligonucleotide
uuucaagaggggaaaaaauuu

SEQ ID NO: 33114 - RNA, 21 nt, Artificial Sequence
  Description of Artificial Sequence: Synthetic oligonucleotide
uguucaagaggggaaaaaauu

SEQ ID NO: 33115 - RNA, 21 nt, Artificial Sequence
  Description of Artificial Sequence: Synthetic oligonucleotide
uaguucaagaggggaaaaauu

SEQ ID NO: 33116 - RNA, 21 nt, Artificial Sequence
  Description of Artificial Sequence: Synthetic oligonucleotide
uaaguucaagaggggaaaauu

SEQ ID NO: 33117 - RNA, 21 nt, Artificial Sequence
  Description of Artificial Sequence: Synthetic oligonucleotide
uaaaguucaagaggggaaauu

SEQ ID NO: 33118 - RNA, 21 nt, Artificial Sequence
  Description of Artificial Sequence: Synthetic oligonucleotide
ugaaaguucaagaggggaauu

SEQ ID NO: 33119 - RNA, 21 nt, Artificial Sequence
  Description of Artificial Sequence: Synthetic oligonucleotide
uggaaaguucaagaggggauu

SEQ ID NO: 33120 - RNA, 21 nt, Artificial Sequence
  Description of Artificial Sequence: Synthetic oligonucleotide
uaggaaaguucaagagggguu

SEQ ID NO: 33121 - RNA, 21 nt, Artificial Sequence
  Description of Artificial Sequence: Synthetic oligonucleotide
ugaggaaaguucaagaggguu

SEQ ID NO: 33122 - RNA, 21 nt, Artificial Sequence
  Description of Artificial Sequence: Synthetic oligonucleotide
uugaggaaaguucaagagguu

SEQ ID NO: 33123 - RNA, 21 nt, Artificial Sequence
  Description of Artificial Sequence: Synthetic oligonucleotide
ugugaggaaaguucaagaguu

SEQ ID NO: 33124 - RNA, 21 nt, Artificial Sequence
  Description of Artificial Sequence: Synthetic oligonucleotide
uugugaggaaaguucaagauu

SEQ ID NO: 33125 - RNA, 21 nt, Artificial Sequence
  Description of Artificial Sequence: Synthetic oligonucleotide
ugugugaggaaaguucaaguu

SEQ ID NO: 33126 - RNA, 21 nt, Artificial Sequence
  Description of Artificial Sequence: Synthetic oligonucleotide
uggugugaggaaaguucaauu

SEQ ID NO: 33127 - RNA, 21 nt, Artificial Sequence
  Description of Artificial Sequence: Synthetic oligonucleotide
uaggugugaggaaaguucauu

SEQ ID NO: 33128 - RNA, 21 nt, Artificial Sequence
  Description of Artificial Sequence: Synthetic oligonucleotide
ucaggugugaggaaaguucuu

SEQ ID NO: 33129 - RNA, 21 nt, Artificial Sequence
  Description of Artificial Sequence: Synthetic oligonucleotide
uccaggugugaggaaaguuuu

SEQ ID NO: 33130 - RNA, 21 nt, Artificial Sequence
  Description of Artificial Sequence: Synthetic oligonucleotide
uuccaggugugaggaaaguuu

SEQ ID NO: 33131 - RNA, 21 nt, Artificial Sequence
  Description of Artificial Sequence: Synthetic oligonucleotide
uuuccaggugugaggaaaguu

SEQ ID NO: 33132 - RNA, 21 nt, Artificial Sequence
  Description of Artificial Sequence: Synthetic oligonucleotide
ucuuccaggugugaggaaauu

SEQ ID NO: 33133 - RNA, 21 nt, Artificial Sequence
  Description of Artificial Sequence: Synthetic oligonucleotide
uucuuccaggugugaggaauu

SEQ ID NO: 33134 - RNA, 21 nt, Artificial Sequence
  Description of Artificial Sequence: Synthetic oligonucleotide
uuucuuccaggugugaggauu

SEQ ID NO: 33135 - RNA, 21 nt, Artificial Sequence
  Description of Artificial Sequence: Synthetic oligonucleotide
uuuucuuccaggugugagguu

SEQ ID NO: 33136 - RNA, 21 nt, Artificial Sequence
  Description of Artificial Sequence: Synthetic oligonucleotide
uguuucuuccaggugugaguu

SEQ ID NO: 33137 - RNA, 21 nt, Artificial Sequence
  Description of Artificial Sequence: Synthetic oligonucleotide
uuguuucuuccaggugugauu

SEQ ID NO: 33138 - RNA, 21 nt, Artificial Sequence
  Description of Artificial Sequence: Synthetic oligonucleotide
uuuguuucuuccagguguguu

SEQ ID NO: 33139 - RNA, 21 nt, Artificial Sequence
  Description of Artificial Sequence: Synthetic oligonucleotide
uuuuguuucuuccagguguuu

SEQ ID NO: 33140 - RNA, 21 nt, Artificial Sequence
  Description of Artificial Sequence: Synthetic oligonucleotide
ucuuuguuucuuccagguguu

SEQ ID NO: 33141 - RNA, 21 nt, Artificial Sequence
  Description of Artificial Sequence: Synthetic oligonucleotide
uacuuuguuucuuccagguuu

SEQ ID NO: 33142 - RNA, 21 nt, Artificial Sequence
  Description of Artificial Sequence: Synthetic oligonucleotide
uuacuuuguuucuuccagguu

SEQ ID NO: 33143 - RNA, 21 nt, Artificial Sequence
  Description of Artificial Sequence: Synthetic oligonucleotide
ucuacuuuguuucuuccaguu

SEQ ID NO: 33144 - RNA, 21 nt, Artificial Sequence
  Description of Artificial Sequence: Synthetic oligonucleotide
uccuacuuuguuucuuccauu

SEQ ID NO: 33145 - RNA, 21 nt, Artificial Sequence
  Description of Artificial Sequence: Synthetic oligonucleotide
uuccuacuuuguuucuuccuu

SEQ ID NO: 33146 - RNA, 21 nt, Artificial Sequence
  Description of Artificial Sequence: Synthetic oligonucleotide
uuuccuacuuuguuucuucuu

SEQ ID NO: 33147 - RNA, 21 nt, Artificial Sequence
  Description of Artificial Sequence: Synthetic oligonucleotide
uuuuccuacuuuguuucuuuu

SEQ ID NO: 33148 - RNA, 21 nt, Artificial Sequence
  Description of Artificial Sequence: Synthetic oligonucleotide
uuuuuccuacuuuguuucuuu

SEQ ID NO: 33149 - RNA, 21 nt, Artificial Sequence
  Description of Artificial Sequence: Synthetic oligonucleotide
uuuuuuccuacuuuguuucuu

SEQ ID NO: 33150 - RNA, 21 nt, Artificial Sequence
  Description of Artificial Sequence: Synthetic oligonucleotide
ucuuuuuccuacuuuguuuuu

SEQ ID NO: 33151 - RNA, 21 nt, Artificial Sequence
  Description of Artificial Sequence: Synthetic oligonucleotide
uacuuuuuccuacuuuguuuu

SEQ ID NO: 33152 - RNA, 21 nt, Artificial Sequence
  Description of Artificial Sequence: Synthetic oligonucleotide
ucacuuuuuccuacuuuguuu

SEQ ID NO: 33153 - RNA, 21 nt, Artificial Sequence
  Description of Artificial Sequence: Synthetic oligonucleotide
uucacuuuuuccuacuuuguu

SEQ ID NO: 33154 - RNA, 21 nt, Artificial Sequence
  Description of Artificial Sequence: Synthetic oligonucleotide
uuucacuuuuuccuacuuuuu

SEQ ID NO: 33155 - RNA, 21 nt, Artificial Sequence
  Description of Artificial Sequence: Synthetic oligonucleotide
uguucacuuuuuccuacuuuu

SEQ ID NO: 33156 - RNA, 21 nt, Artificial Sequence
  Description of Artificial Sequence: Synthetic oligonucleotide
uuguucacuuuuuccuacuuu

SEQ ID NO: 33157 - RNA, 21 nt, Artificial Sequence
  Description of Artificial Sequence: Synthetic oligonucleotide
ucuguucacuuuuuccuacuu

SEQ ID NO: 33158 - RNA, 21 nt, Artificial Sequence
  Description of Artificial Sequence: Synthetic oligonucleotide
uccuguucacuuuuuccuauu

SEQ ID NO: 33159 - RNA, 21 nt, Artificial Sequence
  Description of Artificial Sequence: Synthetic oligonucleotide
ucccuguucacuuuuuccuuu

SEQ ID NO: 33160 - RNA, 21 nt, Artificial Sequence
  Description of Artificial Sequence: Synthetic oligonucleotide
uccccuguucacuuuuuccuu

SEQ ID NO: 33161 - RNA, 21 nt, Artificial Sequence
  Description of Artificial Sequence: Synthetic oligonucleotide
uuccccuguucacuuuuucuu

SEQ ID NO: 33162 - RNA, 21 nt, Artificial Sequence
  Description of Artificial Sequence: Synthetic oligonucleotide
uauccccuguucacuuuuuuu

SEQ ID NO: 33163 - RNA, 21 nt, Artificial Sequence
  Description of Artificial Sequence: Synthetic oligonucleotide
ucauccccuguucacuuuuuu

SEQ ID NO: 33164 - RNA, 21 nt, Artificial Sequence
  Description of Artificial Sequence: Synthetic oligonucleotide
uacauccccuguucacuuuuu

SEQ ID NO: 33165 - RNA, 21 nt, Artificial Sequence
  Description of Artificial Sequence: Synthetic oligonucleotide
ugacauccccuguucacuuuu

SEQ ID NO: 33166 - RNA, 21 nt, Artificial Sequence
  Description of Artificial Sequence: Synthetic oligonucleotide
uugacauccccuguucacuuu

SEQ ID NO: 33167 - RNA, 21 nt, Artificial Sequence
  Description of Artificial Sequence: Synthetic oligonucleotide
uuugacauccccuguucacuu

SEQ ID NO: 33168 - RNA, 21 nt, Artificial Sequence
  Description of Artificial Sequence: Synthetic oligonucleotide
uuuugacauccccuguucauu

SEQ ID NO: 33169 - RNA, 21 nt, Artificial Sequence
  Description of Artificial Sequence: Synthetic oligonucleotide
uauuugacauccccuguucuu

SEQ ID NO: 33170 - RNA, 21 nt, Artificial Sequence
  Description of Artificial Sequence: Synthetic oligonucleotide
ugauuugacauccccuguuuu

SEQ ID NO: 33171 - RNA, 21 nt, Artificial Sequence
  Description of Artificial Sequence: Synthetic oligonucleotide
ucgauuugacauccccuguuu

SEQ ID NO: 33172 - RNA, 21 nt, Artificial Sequence
  Description of Artificial Sequence: Synthetic oligonucleotide
uucgauuugacauccccuguu

SEQ ID NO: 33173 - RNA, 21 nt, Artificial Sequence
  Description of Artificial Sequence: Synthetic oligonucleotide
uaucgauuugacauccccuuu

SEQ ID NO: 33174 - RNA, 21 nt, Artificial Sequence
  Description of Artificial Sequence: Synthetic oligonucleotide
uaaucgauuugacauccccuu

SEQ ID NO: 33175 - RNA, 21 nt, Artificial Sequence
  Description of Artificial Sequence: Synthetic oligonucleotide
ugaaucgauuugacaucccuu

SEQ ID NO: 33176 - RNA, 21 nt, Artificial Sequence
  Description of Artificial Sequence: Synthetic oligonucleotide
uagaaucgauuugacauccuu

SEQ ID NO: 33177 - RNA, 21 nt, Artificial Sequence
  Description of Artificial Sequence: Synthetic oligonucleotide
uaagaaucgauuugacaucuu

SEQ ID NO: 33178 - RNA, 21 nt, Artificial Sequence
  Description of Artificial Sequence: Synthetic oligonucleotide
ucaagaaucgauuugacauuu

SEQ ID NO: 33179 - RNA, 21 nt, Artificial Sequence
  Description of Artificial Sequence: Synthetic oligonucleotide
uucaagaaucgauuugacauu

SEQ ID NO: 33180 - RNA, 21 nt, Artificial Sequence
  Description of Artificial Sequence: Synthetic oligonucleotide
uuucaagaaucgauuugacuu

SEQ ID NO: 33181 - RNA, 21 nt, Artificial Sequence
  Description of Artificial Sequence: Synthetic oligonucleotide
uauucaagaaucgauuugauu

SEQ ID NO: 33182 - RNA, 21 nt, Artificial Sequence
  Description of Artificial Sequence: Synthetic oligonucleotide
uaauucaagaaucgauuuguu

SEQ ID NO: 33183 - RNA, 21 nt, Artificial Sequence
  Description of Artificial Sequence: Synthetic oligonucleotide
ugaauucaagaaucgauuuuu

SEQ ID NO: 33184 - RNA, 21 nt, Artificial Sequence
  Description of Artificial Sequence: Synthetic oligonucleotide
uggaauucaagaaucgauuuu

SEQ ID NO: 33185 - RNA, 21 nt, Artificial Sequence
  Description of Artificial Sequence: Synthetic oligonucleotide
ugggaauucaagaaucgauuu

SEQ ID NO: 33186 - RNA, 21 nt, Artificial Sequence
  Description of Artificial Sequence: Synthetic oligonucleotide
ucgggaauucaagaaucgauu

SEQ ID NO: 33187 - RNA, 21 nt, Artificial Sequence
  Description of Artificial Sequence: Synthetic oligonucleotide
ugcgggaauucaagaaucguu

SEQ ID NO: 33188 - RNA, 21 nt, Artificial Sequence
  Description of Artificial Sequence: Synthetic oligonucleotide
uagcgggaauucaagaaucuu

SEQ ID NO: 33189 - RNA, 21 nt, Artificial Sequence
  Description of Artificial Sequence: Synthetic oligonucleotide
ucagcgggaauucaagaauuu

SEQ ID NO: 33190 - RNA, 21 nt, Artificial Sequence
  Description of Artificial Sequence: Synthetic oligonucleotide
ugcagcgggaauucaagaauu

SEQ ID NO: 33191 - RNA, 21 nt, Artificial Sequence
  Description of Artificial Sequence: Synthetic oligonucleotide
uugcagcgggaauucaagauu

SEQ ID NO: 33192 - RNA, 21 nt, Artificial Sequence
  Description of Artificial Sequence: Synthetic oligonucleotide
uuugcagcgggaauucaaguu

SEQ ID NO: 33193 - RNA, 21 nt, Artificial Sequence
  Description of Artificial Sequence: Synthetic oligonucleotide
ucuugcagcgggaauucaauu

SEQ ID NO: 33194 - RNA, 21 nt, Artificial Sequence
  Description of Artificial Sequence: Synthetic oligonucleotide
ugcuugcagcgggaauucauu

SEQ ID NO: 33195 - RNA, 21 nt, Artificial Sequence
  Description of Artificial Sequence: Synthetic oligonucleotide
uagcuugcagcgggaauucuu

SEQ ID NO: 33196 - RNA, 21 nt, Artificial Sequence
  Description of Artificial Sequence: Synthetic oligonucleotide
uuagcuugcagcgggaauuuu

SEQ ID NO: 33197 - RNA, 21 nt, Artificial Sequence
  Description of Artificial Sequence: Synthetic oligonucleotide
ucuagcuugcagcgggaauuu

SEQ ID NO: 33198 - RNA, 21 nt, Artificial Sequence
  Description of Artificial Sequence: Synthetic oligonucleotide
uucuagcuugcagcgggaauu

SEQ ID NO: 33199 - RNA, 21 nt, Artificial Sequence
  Description of Artificial Sequence: Synthetic oligonucleotide
ucucuagcuugcagcgggauu

SEQ ID NO: 33200 - RNA, 21 nt, Artificial Sequence
  Description of Artificial Sequence: Synthetic oligonucleotide
ugcucuagcuugcagcggguu

SEQ ID NO: 33201 - RNA, 21 nt, Artificial Sequence
  Description of Artificial Sequence: Synthetic oligonucleotide
uggcucuagcuugcagcgguu

SEQ ID NO: 33202 - RNA, 21 nt, Artificial Sequence
  Description of Artificial Sequence: Synthetic oligonucleotide
ucggcucuagcuugcagcguu

SEQ ID NO: 33203 - RNA, 21 nt, Artificial Sequence
  Description of Artificial Sequence: Synthetic oligonucleotide
ugcggcucuagcuugcagcuu

SEQ ID NO: 33204 - RNA, 21 nt, Artificial Sequence
  Description of Artificial Sequence: Synthetic oligonucleotide
uugcggcucuagcuugcaguu

SEQ ID NO: 33205 - RNA, 21 nt, Artificial Sequence
  Description of Artificial Sequence: Synthetic oligonucleotide
ucugcggcucuagcuugcauu

SEQ ID NO: 33206 - RNA, 21 nt, Artificial Sequence
  Description of Artificial Sequence: Synthetic oligonucleotide
uccugcggcucuagcuugcuu

SEQ ID NO: 33207 - RNA, 21 nt, Artificial Sequence
  Description of Artificial Sequence: Synthetic oligonucleotide
ugccugcggcucuagcuuguu

SEQ ID NO: 33208 - RNA, 21 nt, Artificial Sequence
  Description of Artificial Sequence: Synthetic oligonucleotide
uugccugcggcucuagcuuuu

SEQ ID NO: 33209 - RNA, 21 nt, Artificial Sequence
  Description of Artificial Sequence: Synthetic oligonucleotide
ugugccugcggcucuagcuuu

SEQ ID NO: 33210 - RNA, 21 nt, Artificial Sequence
  Description of Artificial Sequence: Synthetic oligonucleotide
uggugccugcggcucuagcuu

SEQ ID NO: 33211 - RNA, 21 nt, Artificial Sequence
  Description of Artificial Sequence: Synthetic oligonucleotide
ugggugccugcggcucuaguu

SEQ ID NO: 33212 - RNA, 21 nt, Artificial Sequence
  Description of Artificial Sequence: Synthetic oligonucleotide
uagggugccugcggcucuauu

SEQ ID NO: 33213 - RNA, 21 nt, Artificial Sequence
  Description of Artificial Sequence: Synthetic oligonucleotide
ugagggugccugcggcucuuu

SEQ ID NO: 33214 - RNA, 21 nt, Artificial Sequence
  Description of Artificial Sequence: Synthetic oligonucleotide
uagagggugccugcggcucuu

SEQ ID NO: 33215 - RNA, 21 nt, Artificial Sequence
  Description of Artificial Sequence: Synthetic oligonucleotide
ugagagggugccugcggcuuu

SEQ ID NO: 33216 - RNA, 21 nt, Artificial Sequence
  Description of Artificial Sequence: Synthetic oligonucleotide
uugagagggugccugcggcuu

SEQ ID NO: 33217 - RNA, 21 nt, Artificial Sequence
  Description of Artificial Sequence: Synthetic oligonucleotide
ugugagagggugccugcgguu

SEQ ID NO: 33218 - RNA, 21 nt, Artificial Sequence
  Description of Artificial Sequence: Synthetic oligonucleotide
uagugagagggugccugcguu

SEQ ID NO: 33219 - RNA, 21 nt, Artificial Sequence
  Description of Artificial Sequence: Synthetic oligonucleotide
ugagugagagggugccugcuu

SEQ ID NO: 33220 - RNA, 21 nt, Artificial Sequence
  Description of Artificial Sequence: Synthetic oligonucleotide
uugagugagagggugccuguu

SEQ ID NO: 33221 - RNA, 21 nt, Artificial Sequence
  Description of Artificial Sequence: Synthetic oligonucleotide
uuugagugagagggugccuuu

SEQ ID NO: 33222 - RNA, 21 nt, Artificial Sequence
  Description of Artificial Sequence: Synthetic oligonucleotide
uauugagugagagggugccuu

SEQ ID NO: 33223 - RNA, 21 nt, Artificial Sequence
  Description of Artificial Sequence: Synthetic oligonucleotide
uaauugagugagagggugcuu

SEQ ID NO: 33224 - RNA, 21 nt, Artificial Sequence
  Description of Artificial Sequence: Synthetic oligonucleotide
uaaauugagugagaggguguu

SEQ ID NO: 33225 - RNA, 21 nt, Artificial Sequence
  Description of Artificial Sequence: Synthetic oligonucleotide
ugaaauugagugagaggguuu

SEQ ID NO: 33226 - RNA, 21 nt, Artificial Sequence
  Description of Artificial Sequence: Synthetic oligonucleotide
uggaaauugagugagaggguu

SEQ ID NO: 33227 - RNA, 21 nt, Artificial Sequence
  Description of Artificial Sequence: Synthetic oligonucleotide
uuggaaauugagugagagguu

SEQ ID NO: 33228 - RNA, 21 nt, Artificial Sequence
  Description of Artificial Sequence: Synthetic oligonucleotide
uguggaaauugagugagaguu

SEQ ID NO: 33229 - RNA, 21 nt, Artificial Sequence
  Description of Artificial Sequence: Synthetic oligonucleotide
uaguggaaauugagugagauu

SEQ ID NO: 33230 - RNA, 21 nt, Artificial Sequence
  Description of Artificial Sequence: Synthetic oligonucleotide
ugaguggaaauugagugaguu

SEQ ID NO: 33231 - RNA, 21 nt, Artificial Sequence
  Description of Artificial Sequence: Synthetic oligonucleotide
uugaguggaaauugagugauu

SEQ ID NO: 33232 - RNA, 21 nt, Artificial Sequence
  Description of Artificial Sequence: Synthetic oligonucleotide
ucugaguggaaauugaguguu

SEQ ID NO: 33233 - RNA, 21 nt, Artificial Sequence
  Description of Artificial Sequence: Synthetic oligonucleotide
uucugaguggaaauugaguuu

SEQ ID NO: 33234 - RNA, 21 nt, Artificial Sequence
  Description of Artificial Sequence: Synthetic oligonucleotide
uuucugaguggaaauugaguu

SEQ ID NO: 33235 - RNA, 21 nt, Artificial Sequence
  Description of Artificial Sequence: Synthetic oligonucleotide
uguucugaguggaaauugauu

SEQ ID NO: 33236 - RNA, 21 nt, Artificial Sequence
  Description of Artificial Sequence: Synthetic oligonucleotide
ugguucugaguggaaauuguu

SEQ ID NO: 33237 - RNA, 21 nt, Artificial Sequence
  Description of Artificial Sequence: Synthetic oligonucleotide
uggguucugaguggaaauuuu

SEQ ID NO: 33238 - RNA, 21 nt, Artificial Sequence
  Description of Artificial Sequence: Synthetic oligonucleotide
uaggguucugaguggaaauuu

SEQ ID NO: 33239 - RNA, 21 nt, Artificial Sequence
  Description of Artificial Sequence: Synthetic oligonucleotide
uuaggguucugaguggaaauu

SEQ ID NO: 33240 - RNA, 21 nt, Artificial Sequence
  Description of Artificial Sequence: Synthetic oligonucleotide
uauaggguucugaguggaauu

SEQ ID NO: 33241 - RNA, 21 nt, Artificial Sequence
  Description of Artificial Sequence: Synthetic oligonucleotide
uuauaggguucugaguggauu

SEQ ID NO: 33242 - RNA, 21 nt, Artificial Sequence
  Description of Artificial Sequence: Synthetic oligonucleotide
uuuauaggguucugagugguu

SEQ ID NO: 33243 - RNA, 21 nt, Artificial Sequence
  Description of Artificial Sequence: Synthetic oligonucleotide
uuuuauaggguucugaguguu

SEQ ID NO: 33244 - RNA, 21 nt, Artificial Sequence
  Description of Artificial Sequence: Synthetic oligonucleotide
uguuuauaggguucugaguuu

SEQ ID NO: 33245 - RNA, 21 nt, Artificial Sequence
  Description of Artificial Sequence: Synthetic oligonucleotide
uuguuuauaggguucugaguu

SEQ ID NO: 33246 - RNA, 21 nt, Artificial Sequence
  Description of Artificial Sequence: Synthetic oligonucleotide
uguguuuauaggguucugauu

SEQ ID NO: 33247 - RNA, 21 nt, Artificial Sequence
  Description of Artificial Sequence: Synthetic oligonucleotide
ugguguuuauaggguucuguu

SEQ ID NO: 33248 - RNA, 21 nt, Artificial Sequence
  Description of Artificial Sequence: Synthetic oligonucleotide
uugguguuuauaggguucuuu

SEQ ID NO: 33249 - RNA, 21 nt, Artificial Sequence
  Description of Artificial Sequence: Synthetic oligonucleotide
ucugguguuuauaggguucuu

SEQ ID NO: 33250 - RNA, 21 nt, Artificial Sequence
  Description of Artificial Sequence: Synthetic oligonucleotide
uacugguguuuauaggguuuu

SEQ ID NO: 33251 - RNA, 21 nt, Artificial Sequence
  Description of Artificial Sequence: Synthetic oligonucleotide
ucacugguguuuauaggguuu

SEQ ID NO: 33252 - RNA, 21 nt, Artificial Sequence
  Description of Artificial Sequence: Synthetic oligonucleotide
uccacugguguuuauaggguu

SEQ ID NO: 33253 - RNA, 21 nt, Artificial Sequence
  Description of Artificial Sequence: Synthetic oligonucleotide
ucccacugguguuuauagguu

SEQ ID NO: 33254 - RNA, 21 nt, Artificial Sequence
  Description of Artificial Sequence: Synthetic oligonucleotide
uucccacugguguuuauaguu

SEQ ID NO: 33255 - RNA, 21 nt, Artificial Sequence
  Description of Artificial Sequence: Synthetic oligonucleotide
uuucccacugguguuuauauu

SEQ ID NO: 33256 - RNA, 21 nt, Artificial Sequence
  Description of Artificial Sequence: Synthetic oligonucleotide
ucuucccacugguguuuauuu

SEQ ID NO: 33257 - RNA, 21 nt, Artificial Sequence
  Description of Artificial Sequence: Synthetic oligonucleotide
uccuucccacugguguuuauu

SEQ ID NO: 33258 - RNA, 21 nt, Artificial Sequence
  Description of Artificial Sequence: Synthetic oligonucleotide
ucccuucccacugguguuuuu

SEQ ID NO: 33259 - RNA, 21 nt, Artificial Sequence
  Description of Artificial Sequence: Synthetic oligonucleotide
ugcccuucccacugguguuuu

SEQ ID NO: 33260 - RNA, 21 nt, Artificial Sequence
  Description of Artificial Sequence: Synthetic oligonucleotide
uugcccuucccacugguguuu

SEQ ID NO: 33261 - RNA, 21 nt, Artificial Sequence
  Description of Artificial Sequence: Synthetic oligonucleotide
uuugcccuucccacugguguu

SEQ ID NO: 33262 - RNA, 21 nt, Artificial Sequence
  Description of Artificial Sequence: Synthetic oligonucleotide
uguugcccuucccacugguuu

SEQ ID NO: 33263 - RNA, 21 nt, Artificial Sequence
  Description of Artificial Sequence: Synthetic oligonucleotide
ugguugcccuucccacugguu

SEQ ID NO: 33264 - RNA, 21 nt, Artificial Sequence
  Description of Artificial Sequence: Synthetic oligonucleotide
uggguugcccuucccacuguu

SEQ ID NO: 33265 - RNA, 21 nt, Artificial Sequence
  Description of Artificial Sequence: Synthetic oligonucleotide
uuggguugcccuucccacuuu

SEQ ID NO: 33266 - RNA, 21 nt, Artificial Sequence
  Description of Artificial Sequence: Synthetic oligonucleotide
uguggguugcccuucccacuu

SEQ ID NO: 33267 - RNA, 21 nt, Artificial Sequence
  Description of Artificial Sequence: Synthetic oligonucleotide
uaguggguugcccuucccauu

SEQ ID NO: 33268 - RNA, 21 nt, Artificial Sequence
  Description of Artificial Sequence: Synthetic oligonucleotide
ucaguggguugcccuucccuu

SEQ ID NO: 33269 - RNA, 21 nt, Artificial Sequence
  Description of Artificial Sequence: Synthetic oligonucleotide
ugcaguggguugcccuuccuu

SEQ ID NO: 33270 - RNA, 21 nt, Artificial Sequence
  Description of Artificial Sequence: Synthetic oligonucleotide
uugcaguggguugcccuucuu

SEQ ID NO: 33271 - RNA, 21 nt, Artificial Sequence
  Description of Artificial Sequence: Synthetic oligonucleotide
ugugcaguggguugcccuuuu

SEQ ID NO: 33272 - RNA, 21 nt, Artificial Sequence
  Description of Artificial Sequence: Synthetic oligonucleotide
ucgugcaguggguugcccuuu

SEQ ID NO: 33273 - RNA, 21 nt, Artificial Sequence
  Description of Artificial Sequence: Synthetic oligonucleotide
uacgugcaguggguugcccuu

SEQ ID NO: 33274 - RNA, 21 nt, Artificial Sequence
  Description of Artificial Sequence: Synthetic oligonucleotide
ucacgugcaguggguugccuu

SEQ ID NO: 33275 - RNA, 21 nt, Artificial Sequence
  Description of Artificial Sequence: Synthetic oligonucleotide
uccacgugcaguggguugcuu

SEQ ID NO: 33276 - RNA, 21 nt, Artificial Sequence
  Description of Artificial Sequence: Synthetic oligonucleotide
ucccacgugcaguggguuguu

SEQ ID NO: 33277 - RNA, 21 nt, Artificial Sequence
  Description of Artificial Sequence: Synthetic oligonucleotide
uucccacgugcaguggguuuu

SEQ ID NO: 33278 - RNA, 21 nt, Artificial Sequence
  Description of Artificial Sequence: Synthetic oligonucleotide
uuucccacgugcaguggguuu

SEQ ID NO: 33279 - RNA, 21 nt, Artificial Sequence
  Description of Artificial Sequence: Synthetic oligonucleotide
uauucccacgugcaguggguu

SEQ ID NO: 33280 - RNA, 21 nt, Artificial Sequence
  Description of Artificial Sequence: Synthetic oligonucleotide
ucauucccacgugcagugguu

SEQ ID NO: 33281 - RNA, 21 nt, Artificial Sequence
  Description of Artificial Sequence: Synthetic oligonucleotide
ugcauucccacgugcaguguu

SEQ ID NO: 33282 - RNA, 21 nt, Artificial Sequence
  Description of Artificial Sequence: Synthetic oligonucleotide
uugcauucccacgugcaguuu

SEQ ID NO: 33283 - RNA, 21 nt, Artificial Sequence
  Description of Artificial Sequence: Synthetic oligonucleotide
ugugcauucccacgugcaguu

SEQ ID NO: 33284 - RNA, 21 nt, Artificial Sequence
  Description of Artificial Sequence: Synthetic oligonucleotide
uagugcauucccacgugcauu

SEQ ID NO: 33285 - RNA, 21 nt, Artificial Sequence
  Description of Artificial Sequence: Synthetic oligonucleotide
ucagugcauucccacgugcuu

SEQ ID NO: 33286 - RNA, 21 nt, Artificial Sequence
  Description of Artificial Sequence: Synthetic oligonucleotide
uucagugcauucccacguguu

SEQ ID NO: 33287 - RNA, 21 nt, Artificial Sequence
  Description of Artificial Sequence: Synthetic oligonucleotide
uaucagugcauucccacguuu

SEQ ID NO: 33288 - RNA, 21 nt, Artificial Sequence
  Description of Artificial Sequence: Synthetic oligonucleotide
uaaucagugcauucccacguu

SEQ ID NO: 33289 - RNA, 21 nt, Artificial Sequence
  Description of Artificial Sequence: Synthetic oligonucleotide
uaaaucagugcauucccacuu

SEQ ID NO: 33290 - RNA, 21 nt, Artificial Sequence
  Description of Artificial Sequence: Synthetic oligonucleotide
uaaaaucagugcauucccauu

SEQ ID NO: 33291 - RNA, 21 nt, Artificial Sequence
  Description of Artificial Sequence: Synthetic oligonucleotide
uaaaaaucagugcauucccuu

SEQ ID NO: 33292 - RNA, 21 nt, Artificial Sequence
  Description of Artificial Sequence: Synthetic oligonucleotide
ugaaaaaucagugcauuccuu

SEQ ID NO: 33293 - RNA, 21 nt, Artificial Sequence
  Description of Artificial Sequence: Synthetic oligonucleotide
uggaaaaaucagugcauucuu

SEQ ID NO: 33294 - RNA, 21 nt, Artificial Sequence
  Description of Artificial Sequence: Synthetic oligonucleotide
uaggaaaaaucagugcauuuu

SEQ ID NO: 33295 - RNA, 21 nt, Artificial Sequence
  Description of Artificial Sequence: Synthetic oligonucleotide
uuaggaaaaaucagugcauuu

SEQ ID NO: 33296 - RNA, 21 nt, Artificial Sequence
  Description of Artificial Sequence: Synthetic oligonucleotide
ucuaggaaaaaucagugcauu

SEQ ID NO: 33297 - RNA, 21 nt, Artificial Sequence
  Description of Artificial Sequence: Synthetic oligonucleotide
uccuaggaaaaaucagugcuu

SEQ ID NO: 33298 - RNA, 21 nt, Artificial Sequence
  Description of Artificial Sequence: Synthetic oligonucleotide
uuccuaggaaaaaucaguguu

SEQ ID NO: 33299 - RNA, 21 nt, Artificial Sequence
  Description of Artificial Sequence: Synthetic oligonucleotide
ucuccuaggaaaaaucaguuu

SEQ ID NO: 33300 - RNA, 21 nt, Artificial Sequence
  Description of Artificial Sequence: Synthetic oligonucleotide
uacuccuaggaaaaaucaguu

SEQ ID NO: 33301 - RNA, 21 nt, Artificial Sequence
  Description of Artificial Sequence: Synthetic oligonucleotide
uuacuccuaggaaaaaucauu

SEQ ID NO: 33302 - RNA, 21 nt, Artificial Sequence
  Description of Artificial Sequence: Synthetic oligonucleotide
ucuacuccuaggaaaaaucuu

SEQ ID NO: 33303 - RNA, 21 nt, Artificial Sequence
  Description of Artificial Sequence: Synthetic oligonucleotide
uucuacuccuaggaaaaauuu

SEQ ID NO: 33304 - RNA, 21 nt, Artificial Sequence
  Description of Artificial Sequence: Synthetic oligonucleotide
ugucuacuccuaggaaaaauu

SEQ ID NO: 33305 - RNA, 21 nt, Artificial Sequence
  Description of Artificial Sequence: Synthetic oligonucleotide
uugucuacuccuaggaaaauu

SEQ ID NO: 33306 - RNA, 21 nt, Artificial Sequence
  Description of Artificial Sequence: Synthetic oligonucleotide
uaugucuacuccuaggaaauu

SEQ ID NO: 33307 - RNA, 21 nt, Artificial Sequence
  Description of Artificial Sequence: Synthetic oligonucleotide
ucaugucuacuccuaggaauu

SEQ ID NO: 33308 - RNA, 21 nt, Artificial Sequence
  Description of Artificial Sequence: Synthetic oligonucleotide
uacaugucuacuccuaggauu

SEQ ID NO: 33309 - RNA, 21 nt, Artificial Sequence
  Description of Artificial Sequence: Synthetic oligonucleotide
uaacaugucuacuccuagguu

SEQ ID NO: 33310 - RNA, 21 nt, Artificial Sequence
  Description of Artificial Sequence: Synthetic oligonucleotide
ugaacaugucuacuccuaguu

SEQ ID NO: 33311 - RNA, 21 nt, Artificial Sequence
  Description of Artificial Sequence: Synthetic oligonucleotide
uggaacaugucuacuccuauu

SEQ ID NO: 33312 - RNA, 21 nt, Artificial Sequence
  Description of Artificial Sequence: Synthetic oligonucleotide
uaggaacaugucuacuccuuu

SEQ ID NO: 33313 - RNA, 21 nt, Artificial Sequence
  Description of Artificial Sequence: Synthetic oligonucleotide
ugaggaacaugucuacuccuu

SEQ ID NO: 33314 - RNA, 21 nt, Artificial Sequence
  Description of Artificial Sequence: Synthetic oligonucleotide
uagaggaacaugucuacucuu

SEQ ID NO: 33315 - RNA, 21 nt, Artificial Sequence
  Description of Artificial Sequence: Synthetic oligonucleotide
uuagaggaacaugucuacuuu

SEQ ID NO: 33316 - RNA, 21 nt, Artificial Sequence
  Description of Artificial Sequence: Synthetic oligonucleotide
uuuagaggaacaugucuacuu

SEQ ID NO: 33317 - RNA, 21 nt, Artificial Sequence
  Description of Artificial Sequence: Synthetic oligonucleotide
uauuagaggaacaugucuauu

SEQ ID NO: 33318 - RNA, 21 nt, Artificial Sequence
  Description of Artificial Sequence: Synthetic oligonucleotide
uaauuagaggaacaugucuuu

SEQ ID NO: 33319 - RNA, 21 nt, Artificial Sequence
  Description of Artificial Sequence: Synthetic oligonucleotide
uuaauuagaggaacaugucuu

SEQ ID NO: 33320 - RNA, 21 nt, Artificial Sequence
  Description of Artificial Sequence: Synthetic oligonucleotide
uguaauuagaggaacauguuu

SEQ ID NO: 33321 - RNA, 21 nt, Artificial Sequence
  Description of Artificial Sequence: Synthetic oligonucleotide
uaguaauuagaggaacauguu

SEQ ID NO: 33322 - RNA, 21 nt, Artificial Sequence
  Description of Artificial Sequence: Synthetic oligonucleotide
ugaguaauuagaggaacauuu

SEQ ID NO: 33323 - RNA, 21 nt, Artificial Sequence
  Description of Artificial Sequence: Synthetic oligonucleotide
uggaguaauuagaggaacauu

SEQ ID NO: 33324 - RNA, 21 nt, Artificial Sequence
  Description of Artificial Sequence: Synthetic oligonucleotide
ugggaguaauuagaggaacuu

SEQ ID NO: 33325 - RNA, 21 nt, Artificial Sequence
  Description of Artificial Sequence: Synthetic oligonucleotide
uagggaguaauuagaggaauu

SEQ ID NO: 33326 - RNA, 21 nt, Artificial Sequence
  Description of Artificial Sequence: Synthetic oligonucleotide
ucagggaguaauuagaggauu

SEQ ID NO: 33327 - RNA, 21 nt, Artificial Sequence
  Description of Artificial Sequence: Synthetic oligonucleotide
uucagggaguaauuagagguu

SEQ ID NO: 33328 - RNA, 21 nt, Artificial Sequence
  Description of Artificial Sequence: Synthetic oligonucleotide
ucucagggaguaauuagaguu

SEQ ID NO: 33329 - RNA, 21 nt, Artificial Sequence
  Description of Artificial Sequence: Synthetic oligonucleotide
uccucagggaguaauuagauu

SEQ ID NO: 33330 - RNA, 21 nt, Artificial Sequence
  Description of Artificial Sequence: Synthetic oligonucleotide
ucccucagggaguaauuaguu

SEQ ID NO: 33331 - RNA, 21 nt, Artificial Sequence
  Description of Artificial Sequence: Synthetic oligonucleotide
uacccucagggaguaauuauu

SEQ ID NO: 33332 - RNA, 21 nt, Artificial Sequence
  Description of Artificial Sequence: Synthetic oligonucleotide
uaacccucagggaguaauuuu

SEQ ID NO: 33333 - RNA, 21 nt, Artificial Sequence
  Description of Artificial Sequence: Synthetic oligonucleotide
uuaacccucagggaguaauuu

SEQ ID NO: 33334 - RNA, 21 nt, Artificial Sequence
  Description of Artificial Sequence: Synthetic oligonucleotide
ucuaacccucagggaguaauu

SEQ ID NO: 33335 - RNA, 21 nt, Artificial Sequence
  Description of Artificial Sequence: Synthetic oligonucleotide
uacuaacccucagggaguauu

SEQ ID NO: 33336 - RNA, 21 nt, Artificial Sequence
  Description of Artificial Sequence: Synthetic oligonucleotide
uaacuaacccucagggaguuu

SEQ ID NO: 33337 - RNA, 21 nt, Artificial Sequence
  Description of Artificial Sequence: Synthetic oligonucleotide
ucaacuaacccucagggaguu

SEQ ID NO: 33338 - RNA, 21 nt, Artificial Sequence
  Description of Artificial Sequence: Synthetic oligonucleotide
uccaacuaacccucagggauu

SEQ ID NO: 33339 - RNA, 21 nt, Artificial Sequence
  Description of Artificial Sequence: Synthetic oligonucleotide
ucccaacuaacccucaggguu

SEQ ID NO: 33340 - RNA, 21 nt, Artificial Sequence
  Description of Artificial Sequence: Synthetic oligonucleotide
uccccaacuaacccucagguu

SEQ ID NO: 33341 - RNA, 21 nt, Artificial Sequence
  Description of Artificial Sequence: Synthetic oligonucleotide
ugccccaacuaacccucaguu

SEQ ID NO: 33342 - RNA, 21 nt, Artificial Sequence
  Description of Artificial Sequence: Synthetic oligonucleotide
uagccccaacuaacccucauu

SEQ ID NO: 33343 - RNA, 21 nt, Artificial Sequence
  Description of Artificial Sequence: Synthetic oligonucleotide
uuagccccaacuaacccucuu

SEQ ID NO: 33344 - RNA, 21 nt, Artificial Sequence
  Description of Artificial Sequence: Synthetic oligonucleotide
uuuagccccaacuaacccuuu

SEQ ID NO: 33345 - RNA, 21 nt, Artificial Sequence
  Description of Artificial Sequence: Synthetic oligonucleotide
uuuuagccccaacuaacccuu

SEQ ID NO: 33346 - RNA, 21 nt, Artificial Sequence
  Description of Artificial Sequence: Synthetic oligonucleotide
uguuuagccccaacuaaccuu

SEQ ID NO: 33347 - RNA, 21 nt, Artificial Sequence
  Description of Artificial Sequence: Synthetic oligonucleotide
ugguuuagccccaacuaacuu

SEQ ID NO: 33348 - RNA, 21 nt, Artificial Sequence
  Description of Artificial Sequence: Synthetic oligonucleotide
uugguuuagccccaacuaauu

SEQ ID NO: 33349 - RNA, 21 nt, Artificial Sequence
  Description of Artificial Sequence: Synthetic oligonucleotide
uaugguuuagccccaacuauu

SEQ ID NO: 33350 - RNA, 21 nt, Artificial Sequence
  Description of Artificial Sequence: Synthetic oligonucleotide
ucaugguuuagccccaacuuu

SEQ ID NO: 33351 - RNA, 21 nt, Artificial Sequence
  Description of Artificial Sequence: Synthetic oligonucleotide
uucaugguuuagccccaacuu

SEQ ID NO: 33352 - RNA, 21 nt, Artificial Sequence
  Description of Artificial Sequence: Synthetic oligonucleotide
ugucaugguuuagccccaauu

SEQ ID NO: 33353 - RNA, 21 nt, Artificial Sequence
  Description of Artificial Sequence: Synthetic oligonucleotide
uugucaugguuuagccccauu

SEQ ID NO: 33354 - RNA, 21 nt, Artificial Sequence
  Description of Artificial Sequence: Synthetic oligonucleotide
ucugucaugguuuagccccuu

SEQ ID NO: 33355 - RNA, 21 nt, Artificial Sequence
  Description of Artificial Sequence: Synthetic oligonucleotide
uucugucaugguuuagcccuu

SEQ ID NO: 33356 - RNA, 21 nt, Artificial Sequence
  Description of Artificial Sequence: Synthetic oligonucleotide
uuucugucaugguuuagccuu

SEQ ID NO: 33357 - RNA, 21 nt, Artificial Sequence
  Description of Artificial Sequence: Synthetic oligonucleotide
ucuucugucaugguuuagcuu

SEQ ID NO: 33358 - RNA, 21 nt, Artificial Sequence
  Description of Artificial Sequence: Synthetic oligonucleotide
uacuucugucaugguuuaguu

SEQ ID NO: 33359 - RNA, 21 nt, Artificial Sequence
  Description of Artificial Sequence: Synthetic oligonucleotide
ucacuucugucaugguuuauu

SEQ ID NO: 33360 - RNA, 21 nt, Artificial Sequence
  Description of Artificial Sequence: Synthetic oligonucleotide
uccacuucugucaugguuuuu

SEQ ID NO: 33361 - RNA, 21 nt, Artificial Sequence
  Description of Artificial Sequence: Synthetic oligonucleotide
ucccacuucugucaugguuuu

SEQ ID NO: 33362 - RNA, 21 nt, Artificial Sequence
  Description of Artificial Sequence: Synthetic oligonucleotide
uccccacuucugucaugguuu

SEQ ID NO: 33363 - RNA, 21 nt, Artificial Sequence
  Description of Artificial Sequence: Synthetic oligonucleotide
uuccccacuucugucaugguu

SEQ ID NO: 33364 - RNA, 21 nt, Artificial Sequence
  Description of Artificial Sequence: Synthetic oligonucleotide
uuuccccacuucugucauguu

SEQ ID NO: 33365 - RNA, 21 nt, Artificial Sequence
  Description of Artificial Sequence: Synthetic oligonucleotide
ucuuccccacuucugucauuu

SEQ ID NO: 33366 - RNA, 21 nt, Artificial Sequence
  Description of Artificial Sequence: Synthetic oligonucleotide
uacuuccccacuucugucauu

SEQ ID NO: 33367 - RNA, 21 nt, Artificial Sequence
  Description of Artificial Sequence: Synthetic oligonucleotide
uaacuuccccacuucugucuu

SEQ ID NO: 33368 - RNA, 21 nt, Artificial Sequence
  Description of Artificial Sequence: Synthetic oligonucleotide
ugaacuuccccacuucuguuu

SEQ ID NO: 33369 - RNA, 21 nt, Artificial Sequence
  Description of Artificial Sequence: Synthetic oligonucleotide
uugaacuuccccacuucuguu

SEQ ID NO: 33370 - RNA, 21 nt, Artificial Sequence
  Description of Artificial Sequence: Synthetic oligonucleotide
uuugaacuuccccacuucuuu

SEQ ID NO: 33371 - RNA, 21 nt, Artificial Sequence
  Description of Artificial Sequence: Synthetic oligonucleotide
uauugaacuuccccacuucuu

SEQ ID NO: 33372 - RNA, 21 nt, Artificial Sequence
  Description of Artificial Sequence: Synthetic oligonucleotide
ucauugaacuuccccacuuuu

SEQ ID NO: 33373 - RNA, 21 nt, Artificial Sequence
  Description of Artificial Sequence: Synthetic oligonucleotide
uacauugaacuuccccacuuu

SEQ ID NO: 33374 - RNA, 21 nt, Artificial Sequence
  Description of Artificial Sequence: Synthetic oligonucleotide
ugacauugaacuuccccacuu

SEQ ID NO: 33375 - RNA, 21 nt, Artificial Sequence
  Description of Artificial Sequence: Synthetic oligonucleotide
uggacauugaacuuccccauu

SEQ ID NO: 33376 - RNA, 21 nt, Artificial Sequence
  Description of Artificial Sequence: Synthetic oligonucleotide
uaggacauugaacuuccccuu

SEQ ID NO: 33377 - RNA, 21 nt, Artificial Sequence
  Description of Artificial Sequence: Synthetic oligonucleotide
uaaggacauugaacuucccuu

SEQ ID NO: 33378 - RNA, 21 nt, Artificial Sequence
  Description of Artificial Sequence: Synthetic oligonucleotide
uuaaggacauugaacuuccuu

SEQ ID NO: 33379 - RNA, 21 nt, Artificial Sequence
  Description of Artificial Sequence: Synthetic oligonucleotide
uuuaaggacauugaacuucuu

SEQ ID NO: 33380 - RNA, 21 nt, Artificial Sequence
  Description of Artificial Sequence: Synthetic oligonucleotide
uuuuaaggacauugaacuuuu

SEQ ID NO: 33381 - RNA, 21 nt, Artificial Sequence
  Description of Artificial Sequence: Synthetic oligonucleotide
uauuuaaggacauugaacuuu

SEQ ID NO: 33382 - RNA, 21 nt, Artificial Sequence
  Description of Artificial Sequence: Synthetic oligonucleotide
ugauuuaaggacauugaacuu

SEQ ID NO: 33383 - RNA, 21 nt, Artificial Sequence
  Description of Artificial Sequence: Synthetic oligonucleotide
uggauuuaaggacauugaauu

SEQ ID NO: 33384 - RNA, 21 nt, Artificial Sequence
  Description of Artificial Sequence: Synthetic oligonucleotide
uuggauuuaaggacauugauu

SEQ ID NO: 33385 - RNA, 21 nt, Artificial Sequence
  Description of Artificial Sequence: Synthetic oligonucleotide
uauggauuuaaggacauuguu

SEQ ID NO: 33386 - RNA, 21 nt, Artificial Sequence
  Description of Artificial Sequence: Synthetic oligonucleotide
ugauggauuuaaggacauuuu

SEQ ID NO: 33387 - RNA, 21 nt, Artificial Sequence
  Description of Artificial Sequence: Synthetic oligonucleotide
uagauggauuuaaggacauuu

SEQ ID NO: 33388 - RNA, 21 nt, Artificial Sequence
  Description of Artificial Sequence: Synthetic oligonucleotide
uaagauggauuuaaggacauu

SEQ ID NO: 33389 - RNA, 21 nt, Artificial Sequence
  Description of Artificial Sequence: Synthetic oligonucleotide
uuaagauggauuuaaggacuu

SEQ ID NO: 33390 - RNA, 21 nt, Artificial Sequence
  Description of Artificial Sequence: Synthetic oligonucleotide
uguaagauggauuuaaggauu

SEQ ID NO: 33391 - RNA, 21 nt, Artificial Sequence
  Description of Artificial Sequence: Synthetic oligonucleotide
uaguaagauggauuuaagguu

SEQ ID NO: 33392 - RNA, 21 nt, Artificial Sequence
  Description of Artificial Sequence: Synthetic oligonucleotide
uaaguaagauggauuuaaguu

SEQ ID NO: 33393 - RNA, 21 nt, Artificial Sequence
  Description of Artificial Sequence: Synthetic oligonucleotide
ucaaguaagauggauuuaauu

SEQ ID NO: 33394 - RNA, 21 nt, Artificial Sequence
  Description of Artificial Sequence: Synthetic oligonucleotide
ugcaaguaagauggauuuauu

SEQ ID NO: 33395 - RNA, 21 nt, Artificial Sequence
  Description of Artificial Sequence: Synthetic oligonucleotide
uggcaaguaagauggauuuuu

SEQ ID NO: 33396 - RNA, 21 nt, Artificial Sequence
  Description of Artificial Sequence: Synthetic oligonucleotide
uuggcaaguaagauggauuuu

SEQ ID NO: 33397 - RNA, 21 nt, Artificial Sequence
  Description of Artificial Sequence: Synthetic oligonucleotide
uuuggcaaguaagauggauuu

SEQ ID NO: 33398 - RNA, 21 nt, Artificial Sequence
  Description of Artificial Sequence: Synthetic oligonucleotide
uguuggcaaguaagauggauu

SEQ ID NO: 33399 - RNA, 21 nt, Artificial Sequence
  Description of Artificial Sequence: Synthetic oligonucleotide
uuguuggcaaguaagaugguu

SEQ ID NO: 33400 - RNA, 21 nt, Artificial Sequence
  Description of Artificial Sequence: Synthetic oligonucleotide
ucuguuggcaaguaagauguu

SEQ ID NO: 33401 - RNA, 21 nt, Artificial Sequence
  Description of Artificial Sequence: Synthetic oligonucleotide
uccuguuggcaaguaagauuu

SEQ ID NO: 33402 - RNA, 21 nt, Artificial Sequence
  Description of Artificial Sequence: Synthetic oligonucleotide
uaccuguuggcaaguaagauu

SEQ ID NO: 33403 - RNA, 21 nt, Artificial Sequence
  Description of Artificial Sequence: Synthetic oligonucleotide
uuaccuguuggcaaguaaguu

SEQ ID NO: 33404 - RNA, 21 nt, Artificial Sequence
  Description of Artificial Sequence: Synthetic oligonucleotide
uuuaccuguuggcaaguaauu

SEQ ID NO: 33405 - RNA, 21 nt, Artificial Sequence
  Description of Artificial Sequence: Synthetic oligonucleotide
ucuuaccuguuggcaaguauu

SEQ ID NO: 33406 - RNA, 21 nt, Artificial Sequence
  Description of Artificial Sequence: Synthetic oligonucleotide
uucuuaccuguuggcaaguuu

SEQ ID NO: 33407 - RNA, 21 nt, Artificial Sequence
  Description of Artificial Sequence: Synthetic oligonucleotide
ucucuuaccuguuggcaaguu

SEQ ID NO: 33408 - RNA, 21 nt, Artificial Sequence
  Description of Artificial Sequence: Synthetic oligonucleotide
uccucuuaccuguuggcaauu

SEQ ID NO: 33409 - RNA, 21 nt, Artificial Sequence
  Description of Artificial Sequence: Synthetic oligonucleotide
uuccucuuaccuguuggcauu

SEQ ID NO: 33410 - RNA, 21 nt, Artificial Sequence
  Description of Artificial Sequence: Synthetic oligonucleotide
uuuccucuuaccuguuggcuu

SEQ ID NO: 33411 - RNA, 21 nt, Artificial Sequence
  Description of Artificial Sequence: Synthetic oligonucleotide
ucuuccucuuaccuguugguu

SEQ ID NO: 33412 - RNA, 21 nt, Artificial Sequence
  Description of Artificial Sequence: Synthetic oligonucleotide
ugcuuccucuuaccuguuguu

SEQ ID NO: 33413 - RNA, 21 nt, Artificial Sequence
  Description of Artificial Sequence: Synthetic oligonucleotide
uagcuuccucuuaccuguuuu

SEQ ID NO: 33414 - RNA, 21 nt, Artificial Sequence
  Description of Artificial Sequence: Synthetic oligonucleotide
uaagcuuccucuuaccuguuu

SEQ ID NO: 33415 - RNA, 21 nt, Artificial Sequence
  Description of Artificial Sequence: Synthetic oligonucleotide
uuaagcuuccucuuaccuguu

SEQ ID NO: 33416 - RNA, 21 nt, Artificial Sequence
  Description of Artificial Sequence: Synthetic oligonucleotide
uguaagcuuccucuuaccuuu

SEQ ID NO: 33417 - RNA, 21 nt, Artificial Sequence
  Description of Artificial Sequence: Synthetic oligonucleotide
uuguaagcuuccucuuaccuu

SEQ ID NO: 33418 - RNA, 21 nt, Artificial Sequence
  Description of Artificial Sequence: Synthetic oligonucleotide
uauguaagcuuccucuuacuu

SEQ ID NO: 33419 - RNA, 21 nt, Artificial Sequence
  Description of Artificial Sequence: Synthetic oligonucleotide
uaauguaagcuuccucuuauu

SEQ ID NO: 33420 - RNA, 21 nt, Artificial Sequence
  Description of Artificial Sequence: Synthetic oligonucleotide
uuaauguaagcuuccucuuuu

SEQ ID NO: 33421 - RNA, 21 nt, Artificial Sequence
  Description of Artificial Sequence: Synthetic oligonucleotide
uguaauguaagcuuccucuuu

SEQ ID NO: 33422 - RNA, 21 nt, Artificial Sequence
  Description of Artificial Sequence: Synthetic oligonucleotide
uuguaauguaagcuuccucuu

SEQ ID NO: 33423 - RNA, 21 nt, Artificial Sequence
  Description of Artificial Sequence: Synthetic oligonucleotide
uauguaauguaagcuuccuuu

SEQ ID NO: 33424 - RNA, 21 nt, Artificial Sequence
  Description of Artificial Sequence: Synthetic oligonucleotide
ucauguaauguaagcuuccuu

SEQ ID NO: 33425 - RNA, 21 nt, Artificial Sequence
  Description of Artificial Sequence: Synthetic oligonucleotide
uacauguaauguaagcuucuu

SEQ ID NO: 33426 - RNA, 21 nt, Artificial Sequence
  Description of Artificial Sequence: Synthetic oligonucleotide
ugacauguaauguaagcuuuu

SEQ ID NO: 33427 - RNA, 21 nt, Artificial Sequence
  Description of Artificial Sequence: Synthetic oligonucleotide
uggacauguaauguaagcuuu

SEQ ID NO: 33428 - RNA, 21 nt, Artificial Sequence
  Description of Artificial Sequence: Synthetic oligonucleotide
uuggacauguaauguaagcuu

SEQ ID NO: 33429 - RNA, 21 nt, Artificial Sequence
  Description of Artificial Sequence: Synthetic oligonucleotide
ucuggacauguaauguaaguu

SEQ ID NO: 33430 - RNA, 21 nt, Artificial Sequence
  Description of Artificial Sequence: Synthetic oligonucleotide
uacuggacauguaauguaauu

SEQ ID NO: 33431 - RNA, 21 nt, Artificial Sequence
  Description of Artificial Sequence: Synthetic oligonucleotide
ugacuggacauguaauguauu

SEQ ID NO: 33432 - RNA, 21 nt, Artificial Sequence
  Description of Artificial Sequence: Synthetic oligonucleotide
uggacuggacauguaauguuu

SEQ ID NO: 33433 - RNA, 21 nt, Artificial Sequence
  Description of Artificial Sequence: Synthetic oligonucleotide
uuggacuggacauguaauguu

SEQ ID NO: 33434 - RNA, 21 nt, Artificial Sequence
  Description of Artificial Sequence: Synthetic oligonucleotide
uguggacuggacauguaauuu

SEQ ID NO: 33435 - RNA, 21 nt, Artificial Sequence
  Description of Artificial Sequence: Synthetic oligonucleotide
uuguggacuggacauguaauu

SEQ ID NO: 33436 - RNA, 21 nt, Artificial Sequence
  Description of Artificial Sequence: Synthetic oligonucleotide
uauguggacuggacauguauu

SEQ ID NO: 33437 - RNA, 21 nt, Artificial Sequence
  Description of Artificial Sequence: Synthetic oligonucleotide
uaauguggacuggacauguuu

SEQ ID NO: 33438 - RNA, 21 nt, Artificial Sequence
  Description of Artificial Sequence: Synthetic oligonucleotide
uaaauguggacuggacauguu

SEQ ID NO: 33439 - RNA, 21 nt, Artificial Sequence
  Description of Artificial Sequence: Synthetic oligonucleotide
uuaaauguggacuggacauuu

SEQ ID NO: 33440 - RNA, 21 nt, Artificial Sequence
  Description of Artificial Sequence: Synthetic oligonucleotide
uuuaaauguggacuggacauu

SEQ ID NO: 33441 - RNA, 21 nt, Artificial Sequence
  Description of Artificial Sequence: Synthetic oligonucleotide
uuuuaaauguggacuggacuu

SEQ ID NO: 33442 - RNA, 21 nt, Artificial Sequence
  Description of Artificial Sequence: Synthetic oligonucleotide
ucuuuaaauguggacuggauu

SEQ ID NO: 33443 - RNA, 21 nt, Artificial Sequence
  Description of Artificial Sequence: Synthetic oligonucleotide
uucuuuaaauguggacugguu

SEQ ID NO: 33444 - RNA, 21 nt, Artificial Sequence
  Description of Artificial Sequence: Synthetic oligonucleotide
ucucuuuaaauguggacuguu

SEQ ID NO: 33445 - RNA, 21 nt, Artificial Sequence
  Description of Artificial Sequence: Synthetic oligonucleotide
ugcucuuuaaauguggacuuu

SEQ ID NO: 33446 - RNA, 21 nt, Artificial Sequence
  Description of Artificial Sequence: Synthetic oligonucleotide
uugcucuuuaaauguggacuu

SEQ ID NO: 33447 - RNA, 21 nt, Artificial Sequence
  Description of Artificial Sequence: Synthetic oligonucleotide
ugugcucuuuaaauguggauu

SEQ ID NO: 33448 - RNA, 21 nt, Artificial Sequence
  Description of Artificial Sequence: Synthetic oligonucleotide
uagugcucuuuaaaugugguu

SEQ ID NO: 33449 - RNA, 21 nt, Artificial Sequence
  Description of Artificial Sequence: Synthetic oligonucleotide
uaagugcucuuuaaauguguu

SEQ ID NO: 33450 - RNA, 21 nt, Artificial Sequence
  Description of Artificial Sequence: Synthetic oligonucleotide
uuaagugcucuuuaaauguuu

SEQ ID NO: 33451 - RNA, 21 nt, Artificial Sequence
  Description of Artificial Sequence: Synthetic oligonucleotide
uguaagugcucuuuaaauguu

SEQ ID NO: 33452 - RNA, 21 nt, Artificial Sequence
  Description of Artificial Sequence: Synthetic oligonucleotide
uaguaagugcucuuuaaauuu

SEQ ID NO: 33453 - RNA, 21 nt, Artificial Sequence
  Description of Artificial Sequence: Synthetic oligonucleotide
ucaguaagugcucuuuaaauu

SEQ ID NO: 33454 - RNA, 21 nt, Artificial Sequence
  Description of Artificial Sequence: Synthetic oligonucleotide
uacaguaagugcucuuuaauu

SEQ ID NO: 33455 - RNA, 21 nt, Artificial Sequence
  Description of Artificial Sequence: Synthetic oligonucleotide
ucacaguaagugcucuuuauu

SEQ ID NO: 33456 - RNA, 21 nt, Artificial Sequence
  Description of Artificial Sequence: Synthetic oligonucleotide
uccacaguaagugcucuuuuu

SEQ ID NO: 33457 - RNA, 21 nt, Artificial Sequence
  Description of Artificial Sequence: Synthetic oligonucleotide
uuccacaguaagugcucuuuu

SEQ ID NO: 33458 - RNA, 21 nt, Artificial Sequence
  Description of Artificial Sequence: Synthetic oligonucleotide
uuuccacaguaagugcucuuu

SEQ ID NO: 33459 - RNA, 21 nt, Artificial Sequence
  Description of Artificial Sequence: Synthetic oligonucleotide
uguuccacaguaagugcucuu

SEQ ID NO: 33460 - RNA, 21 nt, Artificial Sequence
  Description of Artificial Sequence: Synthetic oligonucleotide
uuguuccacaguaagugcuuu

SEQ ID NO: 33461 - RNA, 21 nt, Artificial Sequence
  Description of Artificial Sequence: Synthetic oligonucleotide
uuuguuccacaguaagugcuu

SEQ ID NO: 33462 - RNA, 21 nt, Artificial Sequence
  Description of Artificial Sequence: Synthetic oligonucleotide
ucuuguuccacaguaaguguu

SEQ ID NO: 33463 - RNA, 21 nt, Artificial Sequence
  Description of Artificial Sequence: Synthetic oligonucleotide
ugcuuguuccacaguaaguuu

SEQ ID NO: 33464 - RNA, 21 nt, Artificial Sequence
  Description of Artificial Sequence: Synthetic oligonucleotide
uggcuuguuccacaguaaguu

SEQ ID NO: 33465 - RNA, 21 nt, Artificial Sequence
  Description of Artificial Sequence: Synthetic oligonucleotide
uaggcuuguuccacaguaauu

SEQ ID NO: 33466 - RNA, 21 nt, Artificial Sequence
  Description of Artificial Sequence: Synthetic oligonucleotide
uaaggcuuguuccacaguauu

SEQ ID NO: 33467 - RNA, 21 nt, Artificial Sequence
  Description of Artificial Sequence: Synthetic oligonucleotide
ugaaggcuuguuccacaguuu

SEQ ID NO: 33468 - RNA, 21 nt, Artificial Sequence
  Description of Artificial Sequence: Synthetic oligonucleotide
uugaaggcuuguuccacaguu

SEQ ID NO: 33469 - RNA, 21 nt, Artificial Sequence
  Description of Artificial Sequence: Synthetic oligonucleotide
ucugaaggcuuguuccacauu

SEQ ID NO: 33470 - RNA, 21 nt, Artificial Sequence
  Description of Artificial Sequence: Synthetic oligonucleotide
ugcugaaggcuuguuccacuu

SEQ ID NO: 33471 - RNA, 21 nt, Artificial Sequence
  Description of Artificial Sequence: Synthetic oligonucleotide
uggcugaaggcuuguuccauu

SEQ ID NO: 33472 - RNA, 21 nt, Artificial Sequence
  Description of Artificial Sequence: Synthetic oligonucleotide
uuggcugaaggcuuguuccuu

SEQ ID NO: 33473 - RNA, 21 nt, Artificial Sequence
  Description of Artificial Sequence: Synthetic oligonucleotide
uuuggcugaaggcuuguucuu

SEQ ID NO: 33474 - RNA, 21 nt, Artificial Sequence
  Description of Artificial Sequence: Synthetic oligonucleotide
uuuuggcugaaggcuuguuuu

SEQ ID NO: 33475 - RNA, 21 nt, Artificial Sequence
  Description of Artificial Sequence: Synthetic oligonucleotide
uguuuggcugaaggcuuguuu

SEQ ID NO: 33476 - RNA, 21 nt, Artificial Sequence
  Description of Artificial Sequence: Synthetic oligonucleotide
uuguuuggcugaaggcuuguu

SEQ ID NO: 33477 - RNA, 21 nt, Artificial Sequence
  Description of Artificial Sequence: Synthetic oligonucleotide
uuuguuuggcugaaggcuuuu

SEQ ID NO: 33478 - RNA, 21 nt, Artificial Sequence
  Description of Artificial Sequence: Synthetic oligonucleotide
uauuguuuggcugaaggcuuu

SEQ ID NO: 33479 - RNA, 21 nt, Artificial Sequence
  Description of Artificial Sequence: Synthetic oligonucleotide
ucauuguuuggcugaaggcuu

SEQ ID NO: 33480 - RNA, 21 nt, Artificial Sequence
  Description of Artificial Sequence: Synthetic oligonucleotide
uccauuguuuggcugaagguu

SEQ ID NO: 33481 - RNA, 21 nt, Artificial Sequence
  Description of Artificial Sequence: Synthetic oligonucleotide
ucccauuguuuggcugaaguu

SEQ ID NO: 33482 - RNA, 21 nt, Artificial Sequence
  Description of Artificial Sequence: Synthetic oligonucleotide
uccccauuguuuggcugaauu

SEQ ID NO: 33483 - RNA, 21 nt, Artificial Sequence
  Description of Artificial Sequence: Synthetic oligonucleotide
uuccccauuguuuggcugauu

SEQ ID NO: 33484 - RNA, 21 nt, Artificial Sequence
  Description of Artificial Sequence: Synthetic oligonucleotide
uauccccauuguuuggcuguu

SEQ ID NO: 33485 - RNA, 21 nt, Artificial Sequence
  Description of Artificial Sequence: Synthetic oligonucleotide
uuauccccauuguuuggcuuu

SEQ ID NO: 33486 - RNA, 21 nt, Artificial Sequence
  Description of Artificial Sequence: Synthetic oligonucleotide
ucuauccccauuguuuggcuu

SEQ ID NO: 33487 - RNA, 21 nt, Artificial Sequence
  Description of Artificial Sequence: Synthetic oligonucleotide
uucuauccccauuguuugguu

SEQ ID NO: 33488 - RNA, 21 nt, Artificial Sequence
  Description of Artificial Sequence: Synthetic oligonucleotide
uuucuauccccauuguuuguu

SEQ ID NO: 33489 - RNA, 21 nt, Artificial Sequence
  Description of Artificial Sequence: Synthetic oligonucleotide
uuuucuauccccauuguuuuu

SEQ ID NO: 33490 - RNA, 21 nt, Artificial Sequence
  Description of Artificial Sequence: Synthetic oligonucleotide
uuuuucuauccccauuguuuu

SEQ ID NO: 33491 - RNA, 21 nt, Artificial Sequence
  Description of Artificial Sequence: Synthetic oligonucleotide
ucuuuucuauccccauuguuu

SEQ ID NO: 33492 - RNA, 21 nt, Artificial Sequence
  Description of Artificial Sequence: Synthetic oligonucleotide
uacuuuucuauccccauuguu

SEQ ID NO: 33493 - RNA, 21 nt, Artificial Sequence
  Description of Artificial Sequence: Synthetic oligonucleotide
uuacuuuucuauccccauuuu

SEQ ID NO: 33494 - RNA, 21 nt, Artificial Sequence
  Description of Artificial Sequence: Synthetic oligonucleotide
ucuacuuuucuauccccauuu

SEQ ID NO: 33495 - RNA, 21 nt, Artificial Sequence
  Description of Artificial Sequence: Synthetic oligonucleotide
uccuacuuuucuauccccauu

SEQ ID NO: 33496 - RNA, 21 nt, Artificial Sequence
  Description of Artificial Sequence: Synthetic oligonucleotide
uaccuacuuuucuauccccuu

SEQ ID NO: 33497 - RNA, 21 nt, Artificial Sequence
  Description of Artificial Sequence: Synthetic oligonucleotide
uuaccuacuuuucuaucccuu

SEQ ID NO: 33498 - RNA, 21 nt, Artificial Sequence
  Description of Artificial Sequence: Synthetic oligonucleotide
uuuaccuacuuuucuauccuu

SEQ ID NO: 33499 - RNA, 21 nt, Artificial Sequence
  Description of Artificial Sequence: Synthetic oligonucleotide
ucuuaccuacuuuucuaucuu

SEQ ID NO: 33500 - RNA, 21 nt, Artificial Sequence
  Description of Artificial Sequence: Synthetic oligonucleotide
uucuuaccuacuuuucuauuu

SEQ ID NO: 33501 - RNA, 21 nt, Artificial Sequence
  Description of Artificial Sequence: Synthetic oligonucleotide
ugucuuaccuacuuuucuauu

SEQ ID NO: 33502 - RNA, 21 nt, Artificial Sequence
  Description of Artificial Sequence: Synthetic oligonucleotide
uagucuuaccuacuuuucuuu

SEQ ID NO: 33503 - RNA, 21 nt, Artificial Sequence
  Description of Artificial Sequence: Synthetic oligonucleotide
ugagucuuaccuacuuuucuu

SEQ ID NO: 33504 - RNA, 21 nt, Artificial Sequence
  Description of Artificial Sequence: Synthetic oligonucleotide
uugagucuuaccuacuuuuuu

SEQ ID NO: 33505 - RNA, 21 nt, Artificial Sequence
  Description of Artificial Sequence: Synthetic oligonucleotide
ucugagucuuaccuacuuuuu

SEQ ID NO: 33506 - RNA, 21 nt, Artificial Sequence
  Description of Artificial Sequence: Synthetic oligonucleotide
ugcugagucuuaccuacuuuu

SEQ ID NO: 33507 - RNA, 21 nt, Artificial Sequence
  Description of Artificial Sequence: Synthetic oligonucleotide
uggcugagucuuaccuacuuu

SEQ ID NO: 33508 - RNA, 21 nt, Artificial Sequence
  Description of Artificial Sequence: Synthetic oligonucleotide
uaggcugagucuuaccuacuu

SEQ ID NO: 33509 - RNA, 21 nt, Artificial Sequence
  Description of Artificial Sequence: Synthetic oligonucleotide
uaaggcugagucuuaccuauu

SEQ ID NO: 33510 - RNA, 21 nt, Artificial Sequence
  Description of Artificial Sequence: Synthetic oligonucleotide
uaaaggcugagucuuaccuuu

SEQ ID NO: 33511 - RNA, 21 nt, Artificial Sequence
  Description of Artificial Sequence: Synthetic oligonucleotide
ucaaaggcugagucuuaccuu

SEQ ID NO: 33512 - RNA, 21 nt, Artificial Sequence
  Description of Artificial Sequence: Synthetic oligonucleotide
uacaaaggcugagucuuacuu

SEQ ID NO: 33513 - RNA, 21 nt, Artificial Sequence
  Description of Artificial Sequence: Synthetic oligonucleotide
ugacaaaggcugagucuuauu

SEQ ID NO: 33514 - RNA, 21 nt, Artificial Sequence
  Description of Artificial Sequence: Synthetic oligonucleotide
uggacaaaggcugagucuuuu

SEQ ID NO: 33515 - RNA, 21 nt, Artificial Sequence
  Description of Artificial Sequence: Synthetic oligonucleotide
uuggacaaaggcugagucuuu

SEQ ID NO: 33516 - RNA, 21 nt, Artificial Sequence
  Description of Artificial Sequence: Synthetic oligonucleotide
ucuggacaaaggcugagucuu

SEQ ID NO: 33517 - RNA, 21 nt, Artificial Sequence
  Description of Artificial Sequence: Synthetic oligonucleotide
uucuggacaaaggcugaguuu

SEQ ID NO: 33518 - RNA, 21 nt, Artificial Sequence
  Description of Artificial Sequence: Synthetic oligonucleotide
ucucuggacaaaggcugaguu

SEQ ID NO: 33519 - RNA, 21 nt, Artificial Sequence
  Description of Artificial Sequence: Synthetic oligonucleotide
uucucuggacaaaggcugauu

SEQ ID NO: 33520 - RNA, 21 nt, Artificial Sequence
  Description of Artificial Sequence: Synthetic oligonucleotide
uuucucuggacaaaggcuguu

SEQ ID NO: 33521 - RNA, 21 nt, Artificial Sequence
  Description of Artificial Sequence: Synthetic oligonucleotide
ucuucucuggacaaaggcuuu

SEQ ID NO: 33522 - RNA, 21 nt, Artificial Sequence
  Description of Artificial Sequence: Synthetic oligonucleotide
ugcuucucuggacaaaggcuu

SEQ ID NO: 33523 - RNA, 21 nt, Artificial Sequence
  Description of Artificial Sequence: Synthetic oligonucleotide
uagcuucucuggacaaagguu

SEQ ID NO: 33524 - RNA, 21 nt, Artificial Sequence
  Description of Artificial Sequence: Synthetic oligonucleotide
ugagcuucucuggacaaaguu

SEQ ID NO: 33525 - RNA, 21 nt, Artificial Sequence
  Description of Artificial Sequence: Synthetic oligonucleotide
uugagcuucucuggacaaauu

SEQ ID NO: 33526 - RNA, 21 nt, Artificial Sequence
  Description of Artificial Sequence: Synthetic oligonucleotide
ucugagcuucucuggacaauu

SEQ ID NO: 33527 - RNA, 21 nt, Artificial Sequence
  Description of Artificial Sequence: Synthetic oligonucleotide
uccugagcuucucuggacauu

SEQ ID NO: 33528 - RNA, 21 nt, Artificial Sequence
  Description of Artificial Sequence: Synthetic oligonucleotide
ucccugagcuucucuggacuu

SEQ ID NO: 33529 - RNA, 21 nt, Artificial Sequence
  Description of Artificial Sequence: Synthetic oligonucleotide
uacccugagcuucucuggauu

SEQ ID NO: 33530 - RNA, 21 nt, Artificial Sequence
  Description of Artificial Sequence: Synthetic oligonucleotide
uuacccugagcuucucugguu

SEQ ID NO: 33531 - RNA, 21 nt, Artificial Sequence
  Description of Artificial Sequence: Synthetic oligonucleotide
uauacccugagcuucucuguu

SEQ ID NO: 33532 - RNA, 21 nt, Artificial Sequence
  Description of Artificial Sequence: Synthetic oligonucleotide
uuauacccugagcuucucuuu

SEQ ID NO: 33533 - RNA, 21 nt, Artificial Sequence
  Description of Artificial Sequence: Synthetic oligonucleotide
ucuauacccugagcuucucuu

SEQ ID NO: 33534 - RNA, 21 nt, Artificial Sequence
  Description of Artificial Sequence: Synthetic oligonucleotide
ugcuauacccugagcuucuuu

SEQ ID NO: 33535 - RNA, 21 nt, Artificial Sequence
  Description of Artificial Sequence: Synthetic oligonucleotide
uagcuauacccugagcuucuu

SEQ ID NO: 33536 - RNA, 21 nt, Artificial Sequence
  Description of Artificial Sequence: Synthetic oligonucleotide
ucagcuauacccugagcuuuu

SEQ ID NO: 33537 - RNA, 21 nt, Artificial Sequence
  Description of Artificial Sequence: Synthetic oligonucleotide
uucagcuauacccugagcuuu

SEQ ID NO: 33538 - RNA, 21 nt, Artificial Sequence
  Description of Artificial Sequence: Synthetic oligonucleotide
uuucagcuauacccugagcuu

SEQ ID NO: 33539 - RNA, 21 nt, Artificial Sequence
  Description of Artificial Sequence: Synthetic oligonucleotide
uauucagcuauacccugaguu

SEQ ID NO: 33540 - RNA, 21 nt, Artificial Sequence
  Description of Artificial Sequence: Synthetic oligonucleotide
uuauucagcuauacccugauu

SEQ ID NO: 33541 - RNA, 21 nt, Artificial Sequence
  Description of Artificial Sequence: Synthetic oligonucleotide
ucuauucagcuauacccuguu

SEQ ID NO: 33542 - RNA, 21 nt, Artificial Sequence
  Description of Artificial Sequence: Synthetic oligonucleotide
uccuauucagcuauacccuuu

SEQ ID NO: 33543 - RNA, 21 nt, Artificial Sequence
  Description of Artificial Sequence: Synthetic oligonucleotide
ugccuauucagcuauacccuu

SEQ ID NO: 33544 - RNA, 21 nt, Artificial Sequence
  Description of Artificial Sequence: Synthetic oligonucleotide
uugccuauucagcuauaccuu

SEQ ID NO: 33545 - RNA, 21 nt, Artificial Sequence
  Description of Artificial Sequence: Synthetic oligonucleotide
ucugccuauucagcuauacuu

SEQ ID NO: 33546 - RNA, 21 nt, Artificial Sequence
  Description of Artificial Sequence: Synthetic oligonucleotide
uacugccuauucagcuauauu

SEQ ID NO: 33547 - RNA, 21 nt, Artificial Sequence
  Description of Artificial Sequence: Synthetic oligonucleotide
uaacugccuauucagcuauuu

SEQ ID NO: 33548 - RNA, 21 nt, Artificial Sequence
  Description of Artificial Sequence: Synthetic oligonucleotide
uaaacugccuauucagcuauu

SEQ ID NO: 33549 - RNA, 21 nt, Artificial Sequence
  Description of Artificial Sequence: Synthetic oligonucleotide
ugaaacugccuauucagcuuu

SEQ ID NO: 33550 - RNA, 21 nt, Artificial Sequence
  Description of Artificial Sequence: Synthetic oligonucleotide
uagaaacugccuauucagcuu

SEQ ID NO: 33551 - RNA, 21 nt, Artificial Sequence
  Description of Artificial Sequence: Synthetic oligonucleotide
uaagaaacugccuauucaguu

SEQ ID NO: 33552 - RNA, 21 nt, Artificial Sequence
  Description of Artificial Sequence: Synthetic oligonucleotide
uaaagaaacugccuauucauu

SEQ ID NO: 33553 - RNA, 21 nt, Artificial Sequence
  Description of Artificial Sequence: Synthetic oligonucleotide
uaaaagaaacugccuauucuu

SEQ ID NO: 33554 - RNA, 21 nt, Artificial Sequence
  Description of Artificial Sequence: Synthetic oligonucleotide
ucaaaagaaacugccuauuuu

SEQ ID NO: 33555 - RNA, 21 nt, Artificial Sequence
  Description of Artificial Sequence: Synthetic oligonucleotide
uacaaaagaaacugccuauuu

SEQ ID NO: 33556 - RNA, 21 nt, Artificial Sequence
  Description of Artificial Sequence: Synthetic oligonucleotide
ugacaaaagaaacugccuauu

SEQ ID NO: 33557 - RNA, 21 nt, Artificial Sequence
  Description of Artificial Sequence: Synthetic oligonucleotide
uggacaaaagaaacugccuuu

SEQ ID NO: 33558 - RNA, 21 nt, Artificial Sequence
  Description of Artificial Sequence: Synthetic oligonucleotide
uaggacaaaagaaacugccuu

SEQ ID NO: 33559 - RNA, 21 nt, Artificial Sequence
  Description of Artificial Sequence: Synthetic oligonucleotide
ucaggacaaaagaaacugcuu

SEQ ID NO: 33560 - RNA, 21 nt, Artificial Sequence
  Description of Artificial Sequence: Synthetic oligonucleotide
uucaggacaaaagaaacuguu

SEQ ID NO: 33561 - RNA, 21 nt, Artificial Sequence
  Description of Artificial Sequence: Synthetic oligonucleotide
ucucaggacaaaagaaacuuu

SEQ ID NO: 33562 - RNA, 21 nt, Artificial Sequence
  Description of Artificial Sequence: Synthetic oligonucleotide
uccucaggacaaaagaaacuu

SEQ ID NO: 33563 - RNA, 21 nt, Artificial Sequence
  Description of Artificial Sequence: Synthetic oligonucleotide
uuccucaggacaaaagaaauu

SEQ ID NO: 33564 - RNA, 21 nt, Artificial Sequence
  Description of Artificial Sequence: Synthetic oligonucleotide
uuuccucaggacaaaagaauu

SEQ ID NO: 33565 - RNA, 21 nt, Artificial Sequence
  Description of Artificial Sequence: Synthetic oligonucleotide
uuuuccucaggacaaaagauu

SEQ ID NO: 33566 - RNA, 21 nt, Artificial Sequence
  Description of Artificial Sequence: Synthetic oligonucleotide
uuuuuccucaggacaaaaguu

SEQ ID NO: 33567 - RNA, 21 nt, Artificial Sequence
  Description of Artificial Sequence: Synthetic oligonucleotide
uauuuuccucaggacaaaauu

SEQ ID NO: 33568 - RNA, 21 nt, Artificial Sequence
  Description of Artificial Sequence: Synthetic oligonucleotide
ugauuuuccucaggacaaauu

SEQ ID NO: 33569 - RNA, 21 nt, Artificial Sequence
  Description of Artificial Sequence: Synthetic oligonucleotide
uugauuuuccucaggacaauu

SEQ ID NO: 33570 - RNA, 21 nt, Artificial Sequence
  Description of Artificial Sequence: Synthetic oligonucleotide
ucugauuuuccucaggacauu

SEQ ID NO: 33571 - RNA, 21 nt, Artificial Sequence
  Description of Artificial Sequence: Synthetic oligonucleotide
uccugauuuuccucaggacuu

SEQ ID NO: 33572 - RNA, 21 nt, Artificial Sequence
  Description of Artificial Sequence: Synthetic oligonucleotide
uuccugauuuuccucaggauu

SEQ ID NO: 33573 - RNA, 21 nt, Artificial Sequence
  Description of Artificial Sequence: Synthetic oligonucleotide
uguccugauuuuccucagguu

SEQ ID NO: 33574 - RNA, 21 nt, Artificial Sequence
  Description of Artificial Sequence: Synthetic oligonucleotide
uuguccugauuuuccucaguu

SEQ ID NO: 33575 - RNA, 21 nt, Artificial Sequence
  Description of Artificial Sequence: Synthetic oligonucleotide
uauguccugauuuuccucauu

SEQ ID NO: 33576 - RNA, 21 nt, Artificial Sequence
  Description of Artificial Sequence: Synthetic oligonucleotide
ucauguccugauuuuccucuu

SEQ ID NO: 33577 - RNA, 21 nt, Artificial Sequence
  Description of Artificial Sequence: Synthetic oligonucleotide
ugcauguccugauuuuccuuu

SEQ ID NO: 33578 - RNA, 21 nt, Artificial Sequence
  Description of Artificial Sequence: Synthetic oligonucleotide
uggcauguccugauuuuccuu

SEQ ID NO: 33579 - RNA, 21 nt, Artificial Sequence
  Description of Artificial Sequence: Synthetic oligonucleotide
uaggcauguccugauuuucuu

SEQ ID NO: 33580 - RNA, 21 nt, Artificial Sequence
  Description of Artificial Sequence: Synthetic oligonucleotide
ucaggcauguccugauuuuuu

SEQ ID NO: 33581 - RNA, 21 nt, Artificial Sequence
  Description of Artificial Sequence: Synthetic oligonucleotide
ugcaggcauguccugauuuuu

SEQ ID NO: 33582 - RNA, 21 nt, Artificial Sequence
  Description of Artificial Sequence: Synthetic oligonucleotide
uagcaggcauguccugauuuu

SEQ ID NO: 33583 - RNA, 21 nt, Artificial Sequence
  Description of Artificial Sequence: Synthetic oligonucleotide
uaagcaggcauguccugauuu

SEQ ID NO: 33584 - RNA, 21 nt, Artificial Sequence
  Description of Artificial Sequence: Synthetic oligonucleotide
uaaagcaggcauguccugauu

SEQ ID NO: 33585 - RNA, 21 nt, Artificial Sequence
  Description of Artificial Sequence: Synthetic oligonucleotide
ugaaagcaggcauguccuguu

SEQ ID NO: 33586 - RNA, 21 nt, Artificial Sequence
  Description of Artificial Sequence: Synthetic oligonucleotide
uagaaagcaggcauguccuuu

SEQ ID NO: 33587 - RNA, 21 nt, Artificial Sequence
  Description of Artificial Sequence: Synthetic oligonucleotide
uuagaaagcaggcauguccuu

SEQ ID NO: 33588 - RNA, 21 nt, Artificial Sequence
  Description of Artificial Sequence: Synthetic oligonucleotide
uuuagaaagcaggcaugucuu

SEQ ID NO: 33589 - RNA, 21 nt, Artificial Sequence
  Description of Artificial Sequence: Synthetic oligonucleotide
uuuuagaaagcaggcauguuu

SEQ ID NO: 33590 - RNA, 21 nt, Artificial Sequence
  Description of Artificial Sequence: Synthetic oligonucleotide
uuuuuagaaagcaggcauguu

SEQ ID NO: 33591 - RNA, 21 nt, Artificial Sequence
  Description of Artificial Sequence: Synthetic oligonucleotide
uuuuuuagaaagcaggcauuu

SEQ ID NO: 33592 - RNA, 21 nt, Artificial Sequence
  Description of Artificial Sequence: Synthetic oligonucleotide
uauuuuuagaaagcaggcauu

SEQ ID NO: 33593 - RNA, 21 nt, Artificial Sequence
  Description of Artificial Sequence: Synthetic oligonucleotide
ugauuuuuagaaagcaggcuu

SEQ ID NO: 33594 - RNA, 21 nt, Artificial Sequence
  Description of Artificial Sequence: Synthetic oligonucleotide
uagauuuuuagaaagcagguu

SEQ ID NO: 33595 - RNA, 21 nt, Artificial Sequence
  Description of Artificial Sequence: Synthetic oligonucleotide
uaagauuuuuagaaagcaguu

SEQ ID NO: 33596 - RNA, 21 nt, Artificial Sequence
  Description of Artificial Sequence: Synthetic oligonucleotide
ugaagauuuuuagaaagcauu

SEQ ID NO: 33597 - RNA, 21 nt, Artificial Sequence
  Description of Artificial Sequence: Synthetic oligonucleotide
uggaagauuuuuagaaagcuu

SEQ ID NO: 33598 - RNA, 21 nt, Artificial Sequence
  Description of Artificial Sequence: Synthetic oligonucleotide
uaggaagauuuuuagaaaguu

SEQ ID NO: 33599 - RNA, 21 nt, Artificial Sequence
  Description of Artificial Sequence: Synthetic oligonucleotide
ugaggaagauuuuuagaaauu

SEQ ID NO: 33600 - RNA, 21 nt, Artificial Sequence
  Description of Artificial Sequence: Synthetic oligonucleotide
uagaggaagauuuuuagaauu

SEQ ID NO: 33601 - RNA, 21 nt, Artificial Sequence
  Description of Artificial Sequence: Synthetic oligonucleotide
ucagaggaagauuuuuagauu

SEQ ID NO: 33602 - RNA, 21 nt, Artificial Sequence
  Description of Artificial Sequence: Synthetic oligonucleotide
uucagaggaagauuuuuaguu

SEQ ID NO: 33603 - RNA, 21 nt, Artificial Sequence
  Description of Artificial Sequence: Synthetic oligonucleotide
uuucagaggaagauuuuuauu

SEQ ID NO: 33604 - RNA, 21 nt, Artificial Sequence
  Description of Artificial Sequence: Synthetic oligonucleotide
ucuucagaggaagauuuuuuu

SEQ ID NO: 33605 - RNA, 21 nt, Artificial Sequence
  Description of Artificial Sequence: Synthetic oligonucleotide
uucuucagaggaagauuuuuu

SEQ ID NO: 33606 - RNA, 21 nt, Artificial Sequence
  Description of Artificial Sequence: Synthetic oligonucleotide
ugucuucagaggaagauuuuu

SEQ ID NO: 33607 - RNA, 21 nt, Artificial Sequence
  Description of Artificial Sequence: Synthetic oligonucleotide
uggucuucagaggaagauuuu

SEQ ID NO: 33608 - RNA, 21 nt, Artificial Sequence
  Description of Artificial Sequence: Synthetic oligonucleotide
uaggucuucagaggaagauuu

SEQ ID NO: 33609 - RNA, 21 nt, Artificial Sequence
  Description of Artificial Sequence: Synthetic oligonucleotide
ucaggucuucagaggaagauu

SEQ ID NO: 33610 - RNA, 21 nt, Artificial Sequence
  Description of Artificial Sequence: Synthetic oligonucleotide
uucaggucuucagaggaaguu

SEQ ID NO: 33611 - RNA, 21 nt, Artificial Sequence
  Description of Artificial Sequence: Synthetic oligonucleotide
ugucaggucuucagaggaauu

SEQ ID NO: 33612 - RNA, 21 nt, Artificial Sequence
  Description of Artificial Sequence: Synthetic oligonucleotide
uggucaggucuucagaggauu

SEQ ID NO: 33613 - RNA, 21 nt, Artificial Sequence
  Description of Artificial Sequence: Synthetic oligonucleotide
ugggucaggucuucagagguu

SEQ ID NO: 33614 - RNA, 21 nt, Artificial Sequence
  Description of Artificial Sequence: Synthetic oligonucleotide
uugggucaggucuucagaguu

SEQ ID NO: 33615 - RNA, 21 nt, Artificial Sequence
  Description of Artificial Sequence: Synthetic oligonucleotide
uuugggucaggucuucagauu

SEQ ID NO: 33616 - RNA, 21 nt, Artificial Sequence
  Description of Artificial Sequence: Synthetic oligonucleotide
ucuugggucaggucuucaguu

SEQ ID NO: 33617 - RNA, 21 nt, Artificial Sequence
  Description of Artificial Sequence: Synthetic oligonucleotide
ugcuugggucaggucuucauu

SEQ ID NO: 33618 - RNA, 21 nt, Artificial Sequence
  Description of Artificial Sequence: Synthetic oligonucleotide
uagcuugggucaggucuucuu

SEQ ID NO: 33619 - RNA, 21 nt, Artificial Sequence
  Description of Artificial Sequence: Synthetic oligonucleotide
ugagcuugggucaggucuuuu

SEQ ID NO: 33620 - RNA, 21 nt, Artificial Sequence
  Description of Artificial Sequence: Synthetic oligonucleotide
uagagcuugggucaggucuuu

SEQ ID NO: 33621 - RNA, 21 nt, Artificial Sequence
  Description of Artificial Sequence: Synthetic oligonucleotide
uaagagcuugggucaggucuu

SEQ ID NO: 33622 - RNA, 21 nt, Artificial Sequence
  Description of Artificial Sequence: Synthetic oligonucleotide
uuaagagcuugggucagguuu

SEQ ID NO: 33623 - RNA, 21 nt, Artificial Sequence
  Description of Artificial Sequence: Synthetic oligonucleotide
uuuaagagcuugggucagguu

SEQ ID NO: 33624 - RNA, 21 nt, Artificial Sequence
  Description of Artificial Sequence: Synthetic oligonucleotide
uuuuaagagcuugggucaguu

SEQ ID NO: 33625 - RNA, 21 nt, Artificial Sequence
  Description of Artificial Sequence: Synthetic oligonucleotide
uauuuaagagcuugggucauu

SEQ ID NO: 33626 - RNA, 21 nt, Artificial Sequence
  Description of Artificial Sequence: Synthetic oligonucleotide
ucauuuaagagcuugggucuu

SEQ ID NO: 33627 - RNA, 21 nt, Artificial Sequence
  Description of Artificial Sequence: Synthetic oligonucleotide
ugcauuuaagagcuuggguuu

SEQ ID NO: 33628 - RNA, 21 nt, Artificial Sequence
  Description of Artificial Sequence: Synthetic oligonucleotide
uagcauuuaagagcuuggguu

SEQ ID NO: 33629 - RNA, 21 nt, Artificial Sequence
  Description of Artificial Sequence: Synthetic oligonucleotide
uuagcauuuaagagcuugguu

SEQ ID NO: 33630 - RNA, 21 nt, Artificial Sequence
  Description of Artificial Sequence: Synthetic oligonucleotide
uauagcauuuaagagcuuguu

SEQ ID NO: 33631 - RNA, 21 nt, Artificial Sequence
  Description of Artificial Sequence: Synthetic oligonucleotide
uaauagcauuuaagagcuuuu

SEQ ID NO: 33632 - RNA, 21 nt, Artificial Sequence
  Description of Artificial Sequence: Synthetic oligonucleotide
ucaauagcauuuaagagcuuu

SEQ ID NO: 33633 - RNA, 21 nt, Artificial Sequence
  Description of Artificial Sequence: Synthetic oligonucleotide
uacaauagcauuuaagagcuu

SEQ ID NO: 33634 - RNA, 21 nt, Artificial Sequence
  Description of Artificial Sequence: Synthetic oligonucleotide
uuacaauagcauuuaagaguu

SEQ ID NO: 33635 - RNA, 21 nt, Artificial Sequence
  Description of Artificial Sequence: Synthetic oligonucleotide
uuuacaauagcauuuaagauu

SEQ ID NO: 33636 - RNA, 21 nt, Artificial Sequence
  Description of Artificial Sequence: Synthetic oligonucleotide
ucuuacaauagcauuuaaguu

SEQ ID NO: 33637 - RNA, 21 nt, Artificial Sequence
  Description of Artificial Sequence: Synthetic oligonucleotide
uucuuacaauagcauuuaauu

SEQ ID NO: 33638 - RNA, 21 nt, Artificial Sequence
  Description of Artificial Sequence: Synthetic oligonucleotide
ucucuuacaauagcauuuauu

SEQ ID NO: 33639 - RNA, 21 nt, Artificial Sequence
  Description of Artificial Sequence: Synthetic oligonucleotide
uucucuuacaauagcauuuuu

SEQ ID NO: 33640 - RNA, 21 nt, Artificial Sequence
  Description of Artificial Sequence: Synthetic oligonucleotide
uuucucuuacaauagcauuuu

SEQ ID NO: 33641 - RNA, 21 nt, Artificial Sequence
  Description of Artificial Sequence: Synthetic oligonucleotide
uuuucucuuacaauagcauuu

SEQ ID NO: 33642 - RNA, 21 nt, Artificial Sequence
  Description of Artificial Sequence: Synthetic oligonucleotide
uauuucucuuacaauagcauu

SEQ ID NO: 33643 - RNA, 21 nt, Artificial Sequence
  Description of Artificial Sequence: Synthetic oligonucleotide
uaauuucucuuacaauagcuu

SEQ ID NO: 33644 - RNA, 21 nt, Artificial Sequence
  Description of Artificial Sequence: Synthetic oligonucleotide
uaaauuucucuuacaauaguu

SEQ ID NO: 33645 - RNA, 21 nt, Artificial Sequence
  Description of Artificial Sequence: Synthetic oligonucleotide
ugaaauuucucuuacaauauu

SEQ ID NO: 33646 - RNA, 21 nt, Artificial Sequence
  Description of Artificial Sequence: Synthetic oligonucleotide
uagaaauuucucuuacaauuu

SEQ ID NO: 33647 - RNA, 21 nt, Artificial Sequence
  Description of Artificial Sequence: Synthetic oligonucleotide
uaagaaauuucucuuacaauu

SEQ ID NO: 33648 - RNA, 21 nt, Artificial Sequence
  Description of Artificial Sequence: Synthetic oligonucleotide
uaaagaaauuucucuuacauu

SEQ ID NO: 33649 - RNA, 21 nt, Artificial Sequence
  Description of Artificial Sequence: Synthetic oligonucleotide
ucaaagaaauuucucuuacuu

SEQ ID NO: 33650 - RNA, 21 nt, Artificial Sequence
  Description of Artificial Sequence: Synthetic oligonucleotide
uacaaagaaauuucucuuauu

SEQ ID NO: 33651 - RNA, 21 nt, Artificial Sequence
  Description of Artificial Sequence: Synthetic oligonucleotide
ugacaaagaaauuucucuuuu

SEQ ID NO: 33652 - RNA, 21 nt, Artificial Sequence
  Description of Artificial Sequence: Synthetic oligonucleotide
uagacaaagaaauuucucuuu

SEQ ID NO: 33653 - RNA, 21 nt, Artificial Sequence
  Description of Artificial Sequence: Synthetic oligonucleotide
uuagacaaagaaauuucucuu

SEQ ID NO: 33654 - RNA, 21 nt, Artificial Sequence
  Description of Artificial Sequence: Synthetic oligonucleotide
uauagacaaagaaauuucuuu

SEQ ID NO: 33655 - RNA, 21 nt, Artificial Sequence
  Description of Artificial Sequence: Synthetic oligonucleotide
uaauagacaaagaaauuucuu

SEQ ID NO: 33656 - RNA, 21 nt, Artificial Sequence
  Description of Artificial Sequence: Synthetic oligonucleotide
uuaauagacaaagaaauuuuu

SEQ ID NO: 33657 - RNA, 21 nt, Artificial Sequence
  Description of Artificial Sequence: Synthetic oligonucleotide
uuuaauagacaaagaaauuuu

SEQ ID NO: 33658 - RNA, 21 nt, Artificial Sequence
  Description of Artificial Sequence: Synthetic oligonucleotide
uguuaauagacaaagaaauuu

SEQ ID NO: 33659 - RNA, 21 nt, Artificial Sequence
  Description of Artificial Sequence: Synthetic oligonucleotide
uaguuaauagacaaagaaauu

SEQ ID NO: 33660 - RNA, 21 nt, Artificial Sequence
  Description of Artificial Sequence: Synthetic oligonucleotide
ugaguuaauagacaaagaauu

SEQ ID NO: 33661 - RNA, 21 nt, Artificial Sequence
  Description of Artificial Sequence: Synthetic oligonucleotide
uggaguuaauagacaaagauu

SEQ ID NO: 33662 - RNA, 21 nt, Artificial Sequence
  Description of Artificial Sequence: Synthetic oligonucleotide
uuggaguuaauagacaaaguu

SEQ ID NO: 33663 - RNA, 21 nt, Artificial Sequence
  Description of Artificial Sequence: Synthetic oligonucleotide
uauggaguuaauagacaaauu

SEQ ID NO: 33664 - RNA, 21 nt, Artificial Sequence
  Description of Artificial Sequence: Synthetic oligonucleotide
uaauggaguuaauagacaauu

SEQ ID NO: 33665 - RNA, 21 nt, Artificial Sequence
  Description of Artificial Sequence: Synthetic oligonucleotide
uaaauggaguuaauagacauu

SEQ ID NO: 33666 - RNA, 21 nt, Artificial Sequence
  Description of Artificial Sequence: Synthetic oligonucleotide
uaaaauggaguuaauagacuu

SEQ ID NO: 33667 - RNA, 21 nt, Artificial Sequence
  Description of Artificial Sequence: Synthetic oligonucleotide
uuaaaauggaguuaauagauu

SEQ ID NO: 33668 - RNA, 21 nt, Artificial Sequence
  Description of Artificial Sequence: Synthetic oligonucleotide
ucuaaaauggaguuaauaguu

SEQ ID NO: 33669 - RNA, 21 nt, Artificial Sequence
  Description of Artificial Sequence: Synthetic oligonucleotide
uacuaaaauggaguuaauauu

SEQ ID NO: 33670 - RNA, 21 nt, Artificial Sequence
  Description of Artificial Sequence: Synthetic oligonucleotide
uuacuaaaauggaguuaauuu

SEQ ID NO: 33671 - RNA, 21 nt, Artificial Sequence
  Description of Artificial Sequence: Synthetic oligonucleotide
ucuacuaaaauggaguuaauu

SEQ ID NO: 33672 - RNA, 21 nt, Artificial Sequence
  Description of Artificial Sequence: Synthetic oligonucleotide
uccuacuaaaauggaguuauu

SEQ ID NO: 33673 - RNA, 21 nt, Artificial Sequence
  Description of Artificial Sequence: Synthetic oligonucleotide
ucccuacuaaaauggaguuuu

SEQ ID NO: 33674 - RNA, 21 nt, Artificial Sequence
  Description of Artificial Sequence: Synthetic oligonucleotide
uucccuacuaaaauggaguuu

SEQ ID NO: 33675 - RNA, 21 nt, Artificial Sequence
  Description of Artificial Sequence: Synthetic oligonucleotide
uaucccuacuaaaauggaguu

SEQ ID NO: 33676 - RNA, 21 nt, Artificial Sequence
  Description of Artificial Sequence: Synthetic oligonucleotide
uaaucccuacuaaaauggauu

SEQ ID NO: 33677 - RNA, 21 nt, Artificial Sequence
  Description of Artificial Sequence: Synthetic oligonucleotide
ugaaucccuacuaaaaugguu

SEQ ID NO: 33678 - RNA, 21 nt, Artificial Sequence
  Description of Artificial Sequence: Synthetic oligonucleotide
uugaaucccuacuaaaauguu

SEQ ID NO: 33679 - RNA, 21 nt, Artificial Sequence
  Description of Artificial Sequence: Synthetic oligonucleotide
ugugaaucccuacuaaaauuu

SEQ ID NO: 33680 - RNA, 21 nt, Artificial Sequence
  Description of Artificial Sequence: Synthetic oligonucleotide
uagugaaucccuacuaaaauu

SEQ ID NO: 33681 - RNA, 21 nt, Artificial Sequence
  Description of Artificial Sequence: Synthetic oligonucleotide
ucagugaaucccuacuaaauu

SEQ ID NO: 33682 - RNA, 21 nt, Artificial Sequence
  Description of Artificial Sequence: Synthetic oligonucleotide
uucagugaaucccuacuaauu

SEQ ID NO: 33683 - RNA, 21 nt, Artificial Sequence
  Description of Artificial Sequence: Synthetic oligonucleotide
ugucagugaaucccuacuauu

SEQ ID NO: 33684 - RNA, 21 nt, Artificial Sequence
  Description of Artificial Sequence: Synthetic oligonucleotide
uagucagugaaucccuacuuu

SEQ ID NO: 33685 - RNA, 21 nt, Artificial Sequence
  Description of Artificial Sequence: Synthetic oligonucleotide
uuagucagugaaucccuacuu

SEQ ID NO: 33686 - RNA, 21 nt, Artificial Sequence
  Description of Artificial Sequence: Synthetic oligonucleotide
ucuagucagugaaucccuauu

SEQ ID NO: 33687 - RNA, 21 nt, Artificial Sequence
  Description of Artificial Sequence: Synthetic oligonucleotide
uucuagucagugaaucccuuu

SEQ ID NO: 33688 - RNA, 21 nt, Artificial Sequence
  Description of Artificial Sequence: Synthetic oligonucleotide
uaucuagucagugaaucccuu

SEQ ID NO: 33689 - RNA, 21 nt, Artificial Sequence
  Description of Artificial Sequence: Synthetic oligonucleotide
uaaucuagucagugaauccuu

SEQ ID NO: 33690 - RNA, 21 nt, Artificial Sequence
  Description of Artificial Sequence: Synthetic oligonucleotide
uaaaucuagucagugaaucuu

SEQ ID NO: 33691 - RNA, 21 nt, Artificial Sequence
  Description of Artificial Sequence: Synthetic oligonucleotide
uaaaaucuagucagugaauuu

SEQ ID NO: 33692 - RNA, 21 nt, Artificial Sequence
  Description of Artificial Sequence: Synthetic oligonucleotide
uuaaaaucuagucagugaauu

SEQ ID NO: 33693 - RNA, 21 nt, Artificial Sequence
  Description of Artificial Sequence: Synthetic oligonucleotide
uguaaaaucuagucagugauu

SEQ ID NO: 33694 - RNA, 21 nt, Artificial Sequence
  Description of Artificial Sequence: Synthetic oligonucleotide
uaguaaaaucuagucaguguu

SEQ ID NO: 33695 - RNA, 21 nt, Artificial Sequence
  Description of Artificial Sequence: Synthetic oligonucleotide
ucaguaaaaucuagucaguuu

SEQ ID NO: 33696 - RNA, 21 nt, Artificial Sequence
  Description of Artificial Sequence: Synthetic oligonucleotide
uucaguaaaaucuagucaguu

SEQ ID NO: 33697 - RNA, 21 nt, Artificial Sequence
  Description of Artificial Sequence: Synthetic oligonucleotide
uuucaguaaaaucuagucauu

SEQ ID NO: 33698 - RNA, 21 nt, Artificial Sequence
  Description of Artificial Sequence: Synthetic oligonucleotide
uguucaguaaaaucuagucuu

SEQ ID NO: 33699 - RNA, 21 nt, Artificial Sequence
  Description of Artificial Sequence: Synthetic oligonucleotide
uaguucaguaaaaucuaguuu

SEQ ID NO: 33700 - RNA, 21 nt, Artificial Sequence
  Description of Artificial Sequence: Synthetic oligonucleotide
uuaguucaguaaaaucuaguu

SEQ ID NO: 33701 - RNA, 21 nt, Artificial Sequence
  Description of Artificial Sequence: Synthetic oligonucleotide
uauaguucaguaaaaucuauu

SEQ ID NO: 33702 - RNA, 21 nt, Artificial Sequence
  Description of Artificial Sequence: Synthetic oligonucleotide
ucauaguucaguaaaaucuuu

SEQ ID NO: 33703 - RNA, 21 nt, Artificial Sequence
  Description of Artificial Sequence: Synthetic oligonucleotide
uucauaguucaguaaaaucuu

SEQ ID NO: 33704 - RNA, 21 nt, Artificial Sequence
  Description of Artificial Sequence: Synthetic oligonucleotide
uuucauaguucaguaaaauuu

SEQ ID NO: 33705 - RNA, 21 nt, Artificial Sequence
  Description of Artificial Sequence: Synthetic oligonucleotide
uuuucauaguucaguaaaauu

SEQ ID NO: 33706 - RNA, 21 nt, Artificial Sequence
  Description of Artificial Sequence: Synthetic oligonucleotide
uuuuucauaguucaguaaauu

SEQ ID NO: 33707 - RNA, 21 nt, Artificial Sequence
  Description of Artificial Sequence: Synthetic oligonucleotide
uauuuucauaguucaguaauu

SEQ ID NO: 33708 - RNA, 21 nt, Artificial Sequence
  Description of Artificial Sequence: Synthetic oligonucleotide
uuauuuucauaguucaguauu

SEQ ID NO: 33709 - RNA, 21 nt, Artificial Sequence
  Description of Artificial Sequence: Synthetic oligonucleotide
uuuauuuucauaguucaguuu

SEQ ID NO: 33710 - RNA, 21 nt, Artificial Sequence
  Description of Artificial Sequence: Synthetic oligonucleotide
uuuuauuuucauaguucaguu

SEQ ID NO: 33711 - RNA, 21 nt, Artificial Sequence
  Description of Artificial Sequence: Synthetic oligonucleotide
uauuuauuuucauaguucauu

SEQ ID NO: 33712 - RNA, 21 nt, Artificial Sequence
  Description of Artificial Sequence: Synthetic oligonucleotide
uuauuuauuuucauaguucuu

SEQ ID NO: 33713 - RNA, 21 nt, Artificial Sequence
  Description of Artificial Sequence: Synthetic oligonucleotide
uguauuuauuuucauaguuuu

SEQ ID NO: 33714 - RNA, 21 nt, Artificial Sequence
  Description of Artificial Sequence: Synthetic oligonucleotide
uuguauuuauuuucauaguuu

SEQ ID NO: 33715 - RNA, 21 nt, Artificial Sequence
  Description of Artificial Sequence: Synthetic oligonucleotide
uguguauuuauuuucauaguu

SEQ ID NO: 33716 - RNA, 21 nt, Artificial Sequence
  Description of Artificial Sequence: Synthetic oligonucleotide
uuguguauuuauuuucauauu

SEQ ID NO: 33717 - RNA, 21 nt, Artificial Sequence
  Description of Artificial Sequence: Synthetic oligonucleotide
uauguguauuuauuuucauuu

SEQ ID NO: 33718 - RNA, 21 nt, Artificial Sequence
  Description of Artificial Sequence: Synthetic oligonucleotide
uuauguguauuuauuuucauu

SEQ ID NO: 33719 - RNA, 21 nt, Artificial Sequence
  Description of Artificial Sequence: Synthetic oligonucleotide
uuuauguguauuuauuuucuu

SEQ ID NO: 33720 - RNA, 21 nt, Artificial Sequence
  Description of Artificial Sequence: Synthetic oligonucleotide
uauuauguguauuuauuuuuu

SEQ ID NO: 33721 - RNA, 21 nt, Artificial Sequence
  Description of Artificial Sequence: Synthetic oligonucleotide
uaauuauguguauuuauuuuu

SEQ ID NO: 33722 - RNA, 21 nt, Artificial Sequence
  Description of Artificial Sequence: Synthetic oligonucleotide
uaaauuauguguauuuauuuu

SEQ ID NO: 33723 - RNA, 21 nt, Artificial Sequence
  Description of Artificial Sequence: Synthetic oligonucleotide
uaaaauuauguguauuuauuu

SEQ ID NO: 33724 - RNA, 21 nt, Artificial Sequence
  Description of Artificial Sequence: Synthetic oligonucleotide
uaaaaauuauguguauuuauu

SEQ ID NO: 33725 - RNA, 21 nt, Artificial Sequence
  Description of Artificial Sequence: Synthetic oligonucleotide
ugaaaaauuauguguauuuuu

SEQ ID NO: 33726 - RNA, 21 nt, Artificial Sequence
  Description of Artificial Sequence: Synthetic oligonucleotide
uugaaaaauuauguguauuuu

SEQ ID NO: 33727 - RNA, 21 nt, Artificial Sequence
  Description of Artificial Sequence: Synthetic oligonucleotide
ugugaaaaauuauguguauuu

SEQ ID NO: 33728 - RNA, 21 nt, Artificial Sequence
  Description of Artificial Sequence: Synthetic oligonucleotide
uugugaaaaauuauguguauu

SEQ ID NO: 33729 - RNA, 21 nt, Artificial Sequence
  Description of Artificial Sequence: Synthetic oligonucleotide
uuugugaaaaauuauguguuu

SEQ ID NO: 33730 - RNA, 21 nt, Artificial Sequence
  Description of Artificial Sequence: Synthetic oligonucleotide
uuuugugaaaaauuauguguu

SEQ ID NO: 33731 - RNA, 21 nt, Artificial Sequence
  Description of Artificial Sequence: Synthetic oligonucleotide
uuuuugugaaaaauuauguuu

SEQ ID NO: 33732 - RNA, 21 nt, Artificial Sequence
  Description of Artificial Sequence: Synthetic oligonucleotide
uauuuugugaaaaauuauguu

SEQ ID NO: 33733 - RNA, 21 nt, Artificial Sequence
  Description of Artificial Sequence: Synthetic oligonucleotide
uaauuuugugaaaaauuauuu

SEQ ID NO: 33734 - RNA, 21 nt, Artificial Sequence
  Description of Artificial Sequence: Synthetic oligonucleotide
uaaauuuugugaaaaauuauu

SEQ ID NO: 33735 - RNA, 21 nt, Artificial Sequence
  Description of Artificial Sequence: Synthetic oligonucleotide
uaaaauuuugugaaaaauuuu

SEQ ID NO: 33736 - RNA, 21 nt, Artificial Sequence
  Description of Artificial Sequence: Synthetic oligonucleotide
ucaaaauuuugugaaaaauuu

SEQ ID NO: 33737 - RNA, 21 nt, Artificial Sequence
  Description of Artificial Sequence: Synthetic oligonucleotide
uccaaaauuuugugaaaaauu

SEQ ID NO: 33738 - RNA, 21 nt, Artificial Sequence
  Description of Artificial Sequence: Synthetic oligonucleotide
ucccaaaauuuugugaaaauu

SEQ ID NO: 33739 - RNA, 21 nt, Artificial Sequence
  Description of Artificial Sequence: Synthetic oligonucleotide
ugcccaaaauuuugugaaauu

SEQ ID NO: 33740 - RNA, 21 nt, Artificial Sequence
  Description of Artificial Sequence: Synthetic oligonucleotide
uggcccaaaauuuugugaauu

SEQ ID NO: 33741 - RNA, 21 nt, Artificial Sequence
  Description of Artificial Sequence: Synthetic oligonucleotide
ugggcccaaaauuuugugauu

SEQ ID NO: 33742 - RNA, 21 nt, Artificial Sequence
  Description of Artificial Sequence: Synthetic oligonucleotide
uugggcccaaaauuuuguguu

SEQ ID NO: 33743 - RNA, 21 nt, Artificial Sequence
  Description of Artificial Sequence: Synthetic oligonucleotide
uuugggcccaaaauuuuguuu

SEQ ID NO: 33744 - RNA, 21 nt, Artificial Sequence
  Description of Artificial Sequence: Synthetic oligonucleotide
uauugggcccaaaauuuuguu

SEQ ID NO: 33745 - RNA, 21 nt, Artificial Sequence
  Description of Artificial Sequence: Synthetic oligonucleotide
uaauugggcccaaaauuuuuu

SEQ ID NO: 33746 - RNA, 21 nt, Artificial Sequence
  Description of Artificial Sequence: Synthetic oligonucleotide
ugaauugggcccaaaauuuuu

SEQ ID NO: 33747 - RNA, 21 nt, Artificial Sequence
  Description of Artificial Sequence: Synthetic oligonucleotide
uggaauugggcccaaaauuuu

SEQ ID NO: 33748 - RNA, 21 nt, Artificial Sequence
  Description of Artificial Sequence: Synthetic oligonucleotide
ugggaauugggcccaaaauuu

SEQ ID NO: 33749 - RNA, 21 nt, Artificial Sequence
  Description of Artificial Sequence: Synthetic oligonucleotide
uggggaauugggcccaaaauu

SEQ ID NO: 33750 - RNA, 21 nt, Artificial Sequence
  Description of Artificial Sequence: Synthetic oligonucleotide
uaggggaauugggcccaaauu

SEQ ID NO: 33751 - RNA, 21 nt, Artificial Sequence
  Description of Artificial Sequence: Synthetic oligonucleotide
uuaggggaauugggcccaauu

SEQ ID NO: 33752 - RNA, 21 nt, Artificial Sequence
  Description of Artificial Sequence: Synthetic oligonucleotide
uuuaggggaauugggcccauu

SEQ ID NO: 33753 - RNA, 21 nt, Artificial Sequence
  Description of Artificial Sequence: Synthetic oligonucleotide
uuuuaggggaauugggcccuu

SEQ ID NO: 33754 - RNA, 21 nt, Artificial Sequence
  Description of Artificial Sequence: Synthetic oligonucleotide
uuuuuaggggaauugggccuu

SEQ ID NO: 33755 - RNA, 21 nt, Artificial Sequence
  Description of Artificial Sequence: Synthetic oligonucleotide
ucuuuuaggggaauugggcuu

SEQ ID NO: 33756 - RNA, 21 nt, Artificial Sequence
  Description of Artificial Sequence: Synthetic oligonucleotide
uucuuuuaggggaauuggguu

SEQ ID NO: 33757 - RNA, 21 nt, Artificial Sequence
  Description of Artificial Sequence: Synthetic oligonucleotide
uuucuuuuaggggaauugguu

SEQ ID NO: 33758 - RNA, 21 nt, Artificial Sequence
  Description of Artificial Sequence: Synthetic oligonucleotide
uauucuuuuaggggaauuguu

SEQ ID NO: 33759 - RNA, 21 nt, Artificial Sequence
  Description of Artificial Sequence: Synthetic oligonucleotide
uaauucuuuuaggggaauuuu

SEQ ID NO: 33760 - RNA, 21 nt, Artificial Sequence
  Description of Artificial Sequence: Synthetic oligonucleotide
ucaauucuuuuaggggaauuu

SEQ ID NO: 33761 - RNA, 21 nt, Artificial Sequence
  Description of Artificial Sequence: Synthetic oligonucleotide
uucaauucuuuuaggggaauu

SEQ ID NO: 33762 - RNA, 21 nt, Artificial Sequence
  Description of Artificial Sequence: Synthetic oligonucleotide
ucucaauucuuuuaggggauu

SEQ ID NO: 33763 - RNA, 21 nt, Artificial Sequence
  Description of Artificial Sequence: Synthetic oligonucleotide
uccucaauucuuuuagggguu

SEQ ID NO: 33764 - RNA, 21 nt, Artificial Sequence
  Description of Artificial Sequence: Synthetic oligonucleotide
uuccucaauucuuuuaggguu

SEQ ID NO: 33765 - RNA, 21 nt, Artificial Sequence
  Description of Artificial Sequence: Synthetic oligonucleotide
uauccucaauucuuuuagguu

SEQ ID NO: 33766 - RNA, 21 nt, Artificial Sequence
  Description of Artificial Sequence: Synthetic oligonucleotide
uaauccucaauucuuuuaguu

SEQ ID NO: 33767 - RNA, 21 nt, Artificial Sequence
  Description of Artificial Sequence: Synthetic oligonucleotide
uuaauccucaauucuuuuauu

SEQ ID NO: 33768 - RNA, 21 nt, Artificial Sequence
  Description of Artificial Sequence: Synthetic oligonucleotide
ucuaauccucaauucuuuuuu

SEQ ID NO: 33769 - RNA, 21 nt, Artificial Sequence
  Description of Artificial Sequence: Synthetic oligonucleotide
uccuaauccucaauucuuuuu

SEQ ID NO: 33770 - RNA, 21 nt, Artificial Sequence
  Description of Artificial Sequence: Synthetic oligonucleotide
ucccuaauccucaauucuuuu

SEQ ID NO: 33771 - RNA, 21 nt, Artificial Sequence
  Description of Artificial Sequence: Synthetic oligonucleotide
uucccuaauccucaauucuuu

SEQ ID NO: 33772 - RNA, 21 nt, Artificial Sequence
  Description of Artificial Sequence: Synthetic oligonucleotide
ucucccuaauccucaauucuu

SEQ ID NO: 33773 - RNA, 21 nt, Artificial Sequence
  Description of Artificial Sequence: Synthetic oligonucleotide
uucucccuaauccucaauuuu

SEQ ID NO: 33774 - RNA, 21 nt, Artificial Sequence
  Description of Artificial Sequence: Synthetic oligonucleotide
uuucucccuaauccucaauuu

SEQ ID NO: 33775 - RNA, 21 nt, Artificial Sequence
  Description of Artificial Sequence: Synthetic oligonucleotide
uuuucucccuaauccucaauu

SEQ ID NO: 33776 - RNA, 21 nt, Artificial Sequence
  Description of Artificial Sequence: Synthetic oligonucleotide
ucuuucucccuaauccucauu

SEQ ID NO: 33777 - RNA, 21 nt, Artificial Sequence
  Description of Artificial Sequence: Synthetic oligonucleotide
uccuuucucccuaauccucuu

SEQ ID NO: 33778 - RNA, 21 nt, Artificial Sequence
  Description of Artificial Sequence: Synthetic oligonucleotide
uuccuuucucccuaauccuuu

SEQ ID NO: 33779 - RNA, 21 nt, Artificial Sequence
  Description of Artificial Sequence: Synthetic oligonucleotide
ucuccuuucucccuaauccuu

SEQ ID NO: 33780 - RNA, 21 nt, Artificial Sequence
  Description of Artificial Sequence: Synthetic oligonucleotide
uucuccuuucucccuaaucuu

SEQ ID NO: 33781 - RNA, 21 nt, Artificial Sequence
  Description of Artificial Sequence: Synthetic oligonucleotide
ugucuccuuucucccuaauuu

SEQ ID NO: 33782 - RNA, 21 nt, Artificial Sequence
  Description of Artificial Sequence: Synthetic oligonucleotide
uugucuccuuucucccuaauu

SEQ ID NO: 33783 - RNA, 21 nt, Artificial Sequence
  Description of Artificial Sequence: Synthetic oligonucleotide
uuugucuccuuucucccuauu

SEQ ID NO: 33784 - RNA, 21 nt, Artificial Sequence
  Description of Artificial Sequence: Synthetic oligonucleotide
uguugucuccuuucucccuuu

SEQ ID NO: 33785 - RNA, 21 nt, Artificial Sequence
  Description of Artificial Sequence: Synthetic oligonucleotide
uaguugucuccuuucucccuu

SEQ ID NO: 33786 - RNA, 21 nt, Artificial Sequence
  Description of Artificial Sequence: Synthetic oligonucleotide
ugaguugucuccuuucuccuu

SEQ ID NO: 33787 - RNA, 21 nt, Artificial Sequence
  Description of Artificial Sequence: Synthetic oligonucleotide
uugaguugucuccuuucucuu

SEQ ID NO: 33788 - RNA, 21 nt, Artificial Sequence
  Description of Artificial Sequence: Synthetic oligonucleotide
uuugaguugucuccuuucuuu

SEQ ID NO: 33789 - RNA, 21 nt, Artificial Sequence
  Description of Artificial Sequence: Synthetic oligonucleotide
uuuugaguugucuccuuucuu

SEQ ID NO: 33790 - RNA, 21 nt, Artificial Sequence
  Description of Artificial Sequence: Synthetic oligonucleotide
ucuuugaguugucuccuuuuu

SEQ ID NO: 33791 - RNA, 21 nt, Artificial Sequence
  Description of Artificial Sequence: Synthetic oligonucleotide
uacuuugaguugucuccuuuu

SEQ ID NO: 33792 - RNA, 21 nt, Artificial Sequence
  Description of Artificial Sequence: Synthetic oligonucleotide
ugacuuugaguugucuccuuu

SEQ ID NO: 33793 - RNA, 21 nt, Artificial Sequence
  Description of Artificial Sequence: Synthetic oligonucleotide
uugacuuugaguugucuccuu

SEQ ID NO: 33794 - RNA, 21 nt, Artificial Sequence
  Description of Artificial Sequence: Synthetic oligonucleotide
uaugacuuugaguugucucuu

SEQ ID NO: 33795 - RNA, 21 nt, Artificial Sequence
  Description of Artificial Sequence: Synthetic oligonucleotide
ugaugacuuugaguugucuuu

SEQ ID NO: 33796 - RNA, 21 nt, Artificial Sequence
  Description of Artificial Sequence: Synthetic oligonucleotide
uggaugacuuugaguugucuu

SEQ ID NO: 33797 - RNA, 21 nt, Artificial Sequence
  Description of Artificial Sequence: Synthetic oligonucleotide
ugggaugacuuugaguuguuu

SEQ ID NO: 33798 - RNA, 21 nt, Artificial Sequence
  Description of Artificial Sequence: Synthetic oligonucleotide
uugggaugacuuugaguuguu

SEQ ID NO: 33799 - RNA, 21 nt, Artificial Sequence
  Description of Artificial Sequence: Synthetic oligonucleotide
uaugggaugacuuugaguuuu

SEQ ID NO: 33800 - RNA, 21 nt, Artificial Sequence
  Description of Artificial Sequence: Synthetic oligonucleotide
uaaugggaugacuuugaguuu

SEQ ID NO: 33801 - RNA, 21 nt, Artificial Sequence
  Description of Artificial Sequence: Synthetic oligonucleotide
uuaaugggaugacuuugaguu

SEQ ID NO: 33802 - RNA, 21 nt, Artificial Sequence
  Description of Artificial Sequence: Synthetic oligonucleotide
uuuaaugggaugacuuugauu

SEQ ID NO: 33803 - RNA, 21 nt, Artificial Sequence
  Description of Artificial Sequence: Synthetic oligonucleotide
ucuuaaugggaugacuuuguu

SEQ ID NO: 33804 - RNA, 21 nt, Artificial Sequence
  Description of Artificial Sequence: Synthetic oligonucleotide
uacuuaaugggaugacuuuuu

SEQ ID NO: 33805 - RNA, 21 nt, Artificial Sequence
  Description of Artificial Sequence: Synthetic oligonucleotide
ucacuuaaugggaugacuuuu

SEQ ID NO: 33806 - RNA, 21 nt, Artificial Sequence
  Description of Artificial Sequence: Synthetic oligonucleotide
ugcacuuaaugggaugacuuu

SEQ ID NO: 33807 - RNA, 21 nt, Artificial Sequence
  Description of Artificial Sequence: Synthetic oligonucleotide
uugcacuuaaugggaugacuu

SEQ ID NO: 33808 - RNA, 21 nt, Artificial Sequence
  Description of Artificial Sequence: Synthetic oligonucleotide
ucugcacuuaaugggaugauu

SEQ ID NO: 33809 - RNA, 21 nt, Artificial Sequence
  Description of Artificial Sequence: Synthetic oligonucleotide
uacugcacuuaaugggauguu

SEQ ID NO: 33810 - RNA, 21 nt, Artificial Sequence
  Description of Artificial Sequence: Synthetic oligonucleotide
uaacugcacuuaaugggauuu

SEQ ID NO: 33811 - RNA, 21 nt, Artificial Sequence
  Description of Artificial Sequence: Synthetic oligonucleotide
uaaacugcacuuaaugggauu

SEQ ID NO: 33812 - RNA, 21 nt, Artificial Sequence
  Description of Artificial Sequence: Synthetic oligonucleotide
ugaaacugcacuuaauggguu

SEQ ID NO: 33813 - RNA, 21 nt, Artificial Sequence
  Description of Artificial Sequence: Synthetic oligonucleotide
uagaaacugcacuuaaugguu

SEQ ID NO: 33814 - RNA, 21 nt, Artificial Sequence
  Description of Artificial Sequence: Synthetic oligonucleotide
uaagaaacugcacuuaauguu

SEQ ID NO: 33815 - RNA, 21 nt, Artificial Sequence
  Description of Artificial Sequence: Synthetic oligonucleotide
uaaagaaacugcacuuaauuu

SEQ ID NO: 33816 - RNA, 21 nt, Artificial Sequence
  Description of Artificial Sequence: Synthetic oligonucleotide
ucaaagaaacugcacuuaauu

SEQ ID NO: 33817 - RNA, 21 nt, Artificial Sequence
  Description of Artificial Sequence: Synthetic oligonucleotide
uucaaagaaacugcacuuauu

SEQ ID NO: 33818 - RNA, 21 nt, Artificial Sequence
  Description of Artificial Sequence: Synthetic oligonucleotide
uuucaaagaaacugcacuuuu

SEQ ID NO: 33819 - RNA, 21 nt, Artificial Sequence
  Description of Artificial Sequence: Synthetic oligonucleotide
uauucaaagaaacugcacuuu

SEQ ID NO: 33820 - RNA, 21 nt, Artificial Sequence
  Description of Artificial Sequence: Synthetic oligonucleotide
ugauucaaagaaacugcacuu

SEQ ID NO: 33821 - RNA, 21 nt, Artificial Sequence
  Description of Artificial Sequence: Synthetic oligonucleotide
uagauucaaagaaacugcauu

SEQ ID NO: 33822 - RNA, 21 nt, Artificial Sequence
  Description of Artificial Sequence: Synthetic oligonucleotide
uaagauucaaagaaacugcuu

SEQ ID NO: 33823 - RNA, 21 nt, Artificial Sequence
  Description of Artificial Sequence: Synthetic oligonucleotide
ugaagauucaaagaaacuguu

SEQ ID NO: 33824 - RNA, 21 nt, Artificial Sequence
  Description of Artificial Sequence: Synthetic oligonucleotide
uagaagauucaaagaaacuuu

SEQ ID NO: 33825 - RNA, 21 nt, Artificial Sequence
  Description of Artificial Sequence: Synthetic oligonucleotide
ucagaagauucaaagaaacuu

SEQ ID NO: 33826 - RNA, 21 nt, Artificial Sequence
  Description of Artificial Sequence: Synthetic oligonucleotide
ugcagaagauucaaagaaauu

SEQ ID NO: 33827 - RNA, 21 nt, Artificial Sequence
  Description of Artificial Sequence: Synthetic oligonucleotide
uagcagaagauucaaagaauu

SEQ ID NO: 33828 - RNA, 21 nt, Artificial Sequence
  Description of Artificial Sequence: Synthetic oligonucleotide
uaagcagaagauucaaagauu

SEQ ID NO: 33829 - RNA, 21 nt, Artificial Sequence
  Description of Artificial Sequence: Synthetic oligonucleotide
uaaagcagaagauucaaaguu

SEQ ID NO: 33830 - RNA, 21 nt, Artificial Sequence
  Description of Artificial Sequence: Synthetic oligonucleotide
uuaaagcagaagauucaaauu

SEQ ID NO: 33831 - RNA, 21 nt, Artificial Sequence
  Description of Artificial Sequence: Synthetic oligonucleotide
uauaaagcagaagauucaauu

SEQ ID NO: 33832 - RNA, 21 nt, Artificial Sequence
  Description of Artificial Sequence: Synthetic oligonucleotide
ugauaaagcagaagauucauu

SEQ ID NO: 33833 - RNA, 21 nt, Artificial Sequence
  Description of Artificial Sequence: Synthetic oligonucleotide
uagauaaagcagaagauucuu

SEQ ID NO: 33834 - RNA, 21 nt, Artificial Sequence
  Description of Artificial Sequence: Synthetic oligonucleotide
uaagauaaagcagaagauuuu

SEQ ID NO: 33835 - RNA, 21 nt, Artificial Sequence
  Description of Artificial Sequence: Synthetic oligonucleotide
uaaagauaaagcagaagauuu

SEQ ID NO: 33836 - RNA, 21 nt, Artificial Sequence
  Description of Artificial Sequence: Synthetic oligonucleotide
uuaaagauaaagcagaagauu

SEQ ID NO: 33837 - RNA, 21 nt, Artificial Sequence
  Description of Artificial Sequence: Synthetic oligonucleotide
uuuaaagauaaagcagaaguu

SEQ ID NO: 33838 - RNA, 21 nt, Artificial Sequence
  Description of Artificial Sequence: Synthetic oligonucleotide
uuuuaaagauaaagcagaauu

SEQ ID NO: 33839 - RNA, 21 nt, Artificial Sequence
  Description of Artificial Sequence: Synthetic oligonucleotide
uuuuuaaagauaaagcagauu

SEQ ID NO: 33840 - RNA, 21 nt, Artificial Sequence
  Description of Artificial Sequence: Synthetic oligonucleotide
uuuuuuaaagauaaagcaguu

SEQ ID NO: 33841 - RNA, 21 nt, Artificial Sequence
  Description of Artificial Sequence: Synthetic oligonucleotide
uauuuuuaaagauaaagcauu

SEQ ID NO: 33842 - RNA, 21 nt, Artificial Sequence
  Description of Artificial Sequence: Synthetic oligonucleotide
uaauuuuuaaagauaaagcuu

SEQ ID NO: 33843 - RNA, 21 nt, Artificial Sequence
  Description of Artificial Sequence: Synthetic oligonucleotide
uaaauuuuuaaagauaaaguu

SEQ ID NO: 33844 - RNA, 21 nt, Artificial Sequence
  Description of Artificial Sequence: Synthetic oligonucleotide
ucaaauuuuuaaagauaaauu

SEQ ID NO: 33845 - RNA, 21 nt, Artificial Sequence
  Description of Artificial Sequence: Synthetic oligonucleotide
uacaaauuuuuaaagauaauu

SEQ ID NO: 33846 - RNA, 21 nt, Artificial Sequence
  Description of Artificial Sequence: Synthetic oligonucleotide
uuacaaauuuuuaaagauauu

SEQ ID NO: 33847 - RNA, 21 nt, Artificial Sequence
  Description of Artificial Sequence: Synthetic oligonucleotide
uauacaaauuuuuaaagauuu

SEQ ID NO: 33848 - RNA, 21 nt, Artificial Sequence
  Description of Artificial Sequence: Synthetic oligonucleotide
uuauacaaauuuuuaaagauu

SEQ ID NO: 33849 - RNA, 21 nt, Artificial Sequence
  Description of Artificial Sequence: Synthetic oligonucleotide
uuuauacaaauuuuuaaaguu

SEQ ID NO: 33850 - RNA, 21 nt, Artificial Sequence
  Description of Artificial Sequence: Synthetic oligonucleotide
uauuauacaaauuuuuaaauu

SEQ ID NO: 33851 - RNA, 21 nt, Artificial Sequence
  Description of Artificial Sequence: Synthetic oligonucleotide
uaauuauacaaauuuuuaauu

SEQ ID NO: 33852 - RNA, 21 nt, Artificial Sequence
  Description of Artificial Sequence: Synthetic oligonucleotide
uaaauuauacaaauuuuuauu

SEQ ID NO: 33853 - RNA, 21 nt, Artificial Sequence
  Description of Artificial Sequence: Synthetic oligonucleotide
uuaaauuauacaaauuuuuuu

SEQ ID NO: 33854 - RNA, 21 nt, Artificial Sequence
  Description of Artificial Sequence: Synthetic oligonucleotide
uauaaauuauacaaauuuuuu

SEQ ID NO: 33855 - RNA, 21 nt, Artificial Sequence
  Description of Artificial Sequence: Synthetic oligonucleotide
uuauaaauuauacaaauuuuu

SEQ ID NO: 33856 - RNA, 21 nt, Artificial Sequence
  Description of Artificial Sequence: Synthetic oligonucleotide
uauauaaauuauacaaauuuu

SEQ ID NO: 33857 - RNA, 21 nt, Artificial Sequence
  Description of Artificial Sequence: Synthetic oligonucleotide
uuauauaaauuauacaaauuu

SEQ ID NO: 33858 - RNA, 21 nt, Artificial Sequence
  Description of Artificial Sequence: Synthetic oligonucleotide
uauauauaaauuauacaaauu

SEQ ID NO: 33859 - RNA, 21 nt, Artificial Sequence
  Description of Artificial Sequence: Synthetic oligonucleotide
uaauauauaaauuauacaauu

SEQ ID NO: 33860 - RNA, 21 nt, Artificial Sequence
  Description of Artificial Sequence: Synthetic oligonucleotide
uaaauauauaaauuauacauu

SEQ ID NO: 33861 - RNA, 21 nt, Artificial Sequence
  Description of Artificial Sequence: Synthetic oligonucleotide
uaaaauauauaaauuauacuu

SEQ ID NO: 33862 - RNA, 21 nt, Artificial Sequence
  Description of Artificial Sequence: Synthetic oligonucleotide
uuaaaauauauaaauuauauu

SEQ ID NO: 33863 - RNA, 21 nt, Artificial Sequence
  Description of Artificial Sequence: Synthetic oligonucleotide
uauaaaauauauaaauuauuu

SEQ ID NO: 33864 - RNA, 21 nt, Artificial Sequence
  Description of Artificial Sequence: Synthetic oligonucleotide
uaauaaaauauauaaauuauu

SEQ ID NO: 33865 - RNA, 21 nt, Artificial Sequence
  Description of Artificial Sequence: Synthetic oligonucleotide
ugaauaaaauauauaaauuuu

SEQ ID NO: 33866 - RNA, 21 nt, Artificial Sequence
  Description of Artificial Sequence: Synthetic oligonucleotide
uagaauaaaauauauaaauuu

SEQ ID NO: 33867 - RNA, 21 nt, Artificial Sequence
  Description of Artificial Sequence: Synthetic oligonucleotide
uuagaauaaaauauauaaauu

SEQ ID NO: 33868 - RNA, 21 nt, Artificial Sequence
  Description of Artificial Sequence: Synthetic oligonucleotide
uauagaauaaaauauauaauu

SEQ ID NO: 33869 - RNA, 21 nt, Artificial Sequence
  Description of Artificial Sequence: Synthetic oligonucleotide
ucauagaauaaaauauauauu

SEQ ID NO: 33870 - RNA, 21 nt, Artificial Sequence
  Description of Artificial Sequence: Synthetic oligonucleotide
uacauagaauaaaauauauuu

SEQ ID NO: 33871 - RNA, 21 nt, Artificial Sequence
  Description of Artificial Sequence: Synthetic oligonucleotide
ucacauagaauaaaauauauu

SEQ ID NO: 33872 - RNA, 21 nt, Artificial Sequence
  Description of Artificial Sequence: Synthetic oligonucleotide
uacacauagaauaaaauauuu

SEQ ID NO: 33873 - RNA, 21 nt, Artificial Sequence
  Description of Artificial Sequence: Synthetic oligonucleotide
uaacacauagaauaaaauauu

SEQ ID NO: 33874 - RNA, 21 nt, Artificial Sequence
  Description of Artificial Sequence: Synthetic oligonucleotide
ugaacacauagaauaaaauuu

SEQ ID NO: 33875 - RNA, 21 nt, Artificial Sequence
  Description of Artificial Sequence: Synthetic oligonucleotide
uggaacacauagaauaaaauu

SEQ ID NO: 33876 - RNA, 21 nt, Artificial Sequence
  Description of Artificial Sequence: Synthetic oligonucleotide
uuggaacacauagaauaaauu

SEQ ID NO: 33877 - RNA, 21 nt, Artificial Sequence
  Description of Artificial Sequence: Synthetic oligonucleotide
uauggaacacauagaauaauu

SEQ ID NO: 33878 - RNA, 21 nt, Artificial Sequence
  Description of Artificial Sequence: Synthetic oligonucleotide
uuauggaacacauagaauauu

SEQ ID NO: 33879 - RNA, 21 nt, Artificial Sequence
  Description of Artificial Sequence: Synthetic oligonucleotide
ucuauggaacacauagaauuu

SEQ ID NO: 33880 - RNA, 21 nt, Artificial Sequence
  Description of Artificial Sequence: Synthetic oligonucleotide
uucuauggaacacauagaauu

SEQ ID NO: 33881 - RNA, 21 nt, Artificial Sequence
  Description of Artificial Sequence: Synthetic oligonucleotide
uaucuauggaacacauagauu

SEQ ID NO: 33882 - RNA, 21 nt, Artificial Sequence
  Description of Artificial Sequence: Synthetic oligonucleotide
uuaucuauggaacacauaguu

SEQ ID NO: 33883 - RNA, 21 nt, Artificial Sequence
  Description of Artificial Sequence: Synthetic oligonucleotide
uauaucuauggaacacauauu

SEQ ID NO: 33884 - RNA, 21 nt, Artificial Sequence
  Description of Artificial Sequence: Synthetic oligonucleotide
ugauaucuauggaacacauuu

SEQ ID NO: 33885 - RNA, 21 nt, Artificial Sequence
  Description of Artificial Sequence: Synthetic oligonucleotide
uagauaucuauggaacacauu

SEQ ID NO: 33886 - RNA, 21 nt, Artificial Sequence
  Description of Artificial Sequence: Synthetic oligonucleotide
uaagauaucuauggaacacuu

SEQ ID NO: 33887 - RNA, 21 nt, Artificial Sequence
  Description of Artificial Sequence: Synthetic oligonucleotide
uuaagauaucuauggaacauu

SEQ ID NO: 33888 - RNA, 21 nt, Artificial Sequence
  Description of Artificial Sequence: Synthetic oligonucleotide
uuuaagauaucuauggaacuu

SEQ ID NO: 33889 - RNA, 21 nt, Artificial Sequence
  Description of Artificial Sequence: Synthetic oligonucleotide
uauuaagauaucuauggaauu

SEQ ID NO: 33890 - RNA, 21 nt, Artificial Sequence
  Description of Artificial Sequence: Synthetic oligonucleotide
ucauuaagauaucuauggauu

SEQ ID NO: 33891 - RNA, 21 nt, Artificial Sequence
  Description of Artificial Sequence: Synthetic oligonucleotide
uacauuaagauaucuaugguu

SEQ ID NO: 33892 - RNA, 21 nt, Artificial Sequence
  Description of Artificial Sequence: Synthetic oligonucleotide
uuacauuaagauaucuauguu

SEQ ID NO: 33893 - RNA, 21 nt, Artificial Sequence
  Description of Artificial Sequence: Synthetic oligonucleotide
uuuacauuaagauaucuauuu

SEQ ID NO: 33894 - RNA, 21 nt, Artificial Sequence
  Description of Artificial Sequence: Synthetic oligonucleotide
uuuuacauuaagauaucuauu

SEQ ID NO: 33895 - RNA, 21 nt, Artificial Sequence
  Description of Artificial Sequence: Synthetic oligonucleotide
uuuuuacauuaagauaucuuu

SEQ ID NO: 33896 - RNA, 21 nt, Artificial Sequence
  Description of Artificial Sequence: Synthetic oligonucleotide
uauuuuacauuaagauaucuu

SEQ ID NO: 33897 - RNA, 21 nt, Artificial Sequence
  Description of Artificial Sequence: Synthetic oligonucleotide
uaauuuuacauuaagauauuu

SEQ ID NO: 33898 - RNA, 21 nt, Artificial Sequence
  Description of Artificial Sequence: Synthetic oligonucleotide
uuaauuuuacauuaagauauu

SEQ ID NO: 33899 - RNA, 21 nt, Artificial Sequence
  Description of Artificial Sequence: Synthetic oligonucleotide
ucuaauuuuacauuaagauuu

SEQ ID NO: 33900 - RNA, 21 nt, Artificial Sequence
  Description of Artificial Sequence: Synthetic oligonucleotide
uacuaauuuuacauuaagauu

SEQ ID NO: 33901 - RNA, 21 nt, Artificial Sequence
  Description of Artificial Sequence: Synthetic oligonucleotide
ugacuaauuuuacauuaaguu

SEQ ID NO: 33902 - RNA, 21 nt, Artificial Sequence
  Description of Artificial Sequence: Synthetic oligonucleotide
uugacuaauuuuacauuaauu

SEQ ID NO: 33903 - RNA, 21 nt, Artificial Sequence
  Description of Artificial Sequence: Synthetic oligonucleotide
uaugacuaauuuuacauuauu

SEQ ID NO: 33904 - RNA, 21 nt, Artificial Sequence
  Description of Artificial Sequence: Synthetic oligonucleotide
uaaugacuaauuuuacauuuu

SEQ ID NO: 33905 - RNA, 21 nt, Artificial Sequence
  Description of Artificial Sequence: Synthetic oligonucleotide
uaaaugacuaauuuuacauuu

SEQ ID NO: 33906 - RNA, 21 nt, Artificial Sequence
  Description of Artificial Sequence: Synthetic oligonucleotide
uuaaaugacuaauuuuacauu

SEQ ID NO: 33907 - RNA, 21 nt, Artificial Sequence
  Description of Artificial Sequence: Synthetic oligonucleotide
uuuaaaugacuaauuuuacuu

SEQ ID NO: 33908 - RNA, 21 nt, Artificial Sequence
  Description of Artificial Sequence: Synthetic oligonucleotide
uuuuaaaugacuaauuuuauu

SEQ ID NO: 33909 - RNA, 21 nt, Artificial Sequence
  Description of Artificial Sequence: Synthetic oligonucleotide
uauuuaaaugacuaauuuuuu

SEQ ID NO: 33910 - RNA, 21 nt, Artificial Sequence
  Description of Artificial Sequence: Synthetic oligonucleotide
uaauuuaaaugacuaauuuuu

SEQ ID NO: 33911 - RNA, 21 nt, Artificial Sequence
  Description of Artificial Sequence: Synthetic oligonucleotide
uuaauuuaaaugacuaauuuu

SEQ ID NO: 33912 - RNA, 21 nt, Artificial Sequence
  Description of Artificial Sequence: Synthetic oligonucleotide
uguaauuuaaaugacuaauuu

SEQ ID NO: 33913 - RNA, 21 nt, Artificial Sequence
  Description of Artificial Sequence: Synthetic oligonucleotide
uuguaauuuaaaugacuaauu

SEQ ID NO: 33914 - RNA, 21 nt, Artificial Sequence
  Description of Artificial Sequence: Synthetic oligonucleotide
uguguaauuuaaaugacuauu

SEQ ID NO: 33915 - RNA, 21 nt, Artificial Sequence
  Description of Artificial Sequence: Synthetic oligonucleotide
uaguguaauuuaaaugacuuu

SEQ ID NO: 33916 - RNA, 21 nt, Artificial Sequence
  Description of Artificial Sequence: Synthetic oligonucleotide
ucaguguaauuuaaaugacuu

SEQ ID NO: 33917 - RNA, 21 nt, Artificial Sequence
  Description of Artificial Sequence: Synthetic oligonucleotide
uacaguguaauuuaaaugauu

SEQ ID NO: 33918 - RNA, 21 nt, Artificial Sequence
  Description of Artificial Sequence: Synthetic oligonucleotide
ugacaguguaauuuaaauguu

SEQ ID NO: 33919 - RNA, 21 nt, Artificial Sequence
  Description of Artificial Sequence: Synthetic oligonucleotide
uugacaguguaauuuaaauuu

SEQ ID NO: 33920 - RNA, 21 nt, Artificial Sequence
  Description of Artificial Sequence: Synthetic oligonucleotide
uuugacaguguaauuuaaauu

SEQ ID NO: 33921 - RNA, 21 nt, Artificial Sequence
  Description of Artificial Sequence: Synthetic oligonucleotide
uauugacaguguaauuuaauu

SEQ ID NO: 33922 - RNA, 21 nt, Artificial Sequence
  Description of Artificial Sequence: Synthetic oligonucleotide
uaauugacaguguaauuuauu

SEQ ID NO: 33923 - RNA, 21 nt, Artificial Sequence
  Description of Artificial Sequence: Synthetic oligonucleotide
uuaauugacaguguaauuuuu

SEQ ID NO: 33924 - RNA, 21 nt, Artificial Sequence
  Description of Artificial Sequence: Synthetic oligonucleotide
uuuaauugacaguguaauuuu

SEQ ID NO: 33925 - RNA, 21 nt, Artificial Sequence
  Description of Artificial Sequence: Synthetic oligonucleotide
uuuuaauugacaguguaauuu

SEQ ID NO: 33926 - RNA, 21 nt, Artificial Sequence
  Description of Artificial Sequence: Synthetic oligonucleotide
uuuuuaauugacaguguaauu

SEQ ID NO: 33927 - RNA, 21 nt, Artificial Sequence
  Description of Artificial Sequence: Synthetic oligonucleotide
ucuuuuaauugacaguguauu

SEQ ID NO: 33928 - RNA, 21 nt, Artificial Sequence
  Description of Artificial Sequence: Synthetic oligonucleotide
uacuuuuaauugacaguguuu

SEQ ID NO: 33929 - RNA, 21 nt, Artificial Sequence
  Description of Artificial Sequence: Synthetic oligonucleotide
uuacuuuuaauugacaguguu

SEQ ID NO: 33930 - RNA, 21 nt, Artificial Sequence
  Description of Artificial Sequence: Synthetic oligonucleotide
uuuacuuuuaauugacaguuu

SEQ ID NO: 33931 - RNA, 21 nt, Artificial Sequence
  Description of Artificial Sequence: Synthetic oligonucleotide
uauuacuuuuaauugacaguu

SEQ ID NO: 33932 - RNA, 21 nt, Artificial Sequence
  Description of Artificial Sequence: Synthetic oligonucleotide
ucauuacuuuuaauugacauu

SEQ ID NO: 33933 - RNA, 21 nt, Artificial Sequence
  Description of Artificial Sequence: Synthetic oligonucleotide
uccauuacuuuuaauugacuu

SEQ ID NO: 33934 - RNA, 21 nt, Artificial Sequence
  Description of Artificial Sequence: Synthetic oligonucleotide
ucccauuacuuuuaauugauu

SEQ ID NO: 33935 - RNA, 21 nt, Artificial Sequence
  Description of Artificial Sequence: Synthetic oligonucleotide
ugcccauuacuuuuaauuguu

SEQ ID NO: 33936 - RNA, 21 nt, Artificial Sequence
  Description of Artificial Sequence: Synthetic oligonucleotide
uugcccauuacuuuuaauuuu

SEQ ID NO: 33937 - RNA, 21 nt, Artificial Sequence
  Description of Artificial Sequence: Synthetic oligonucleotide
uuugcccauuacuuuuaauuu

SEQ ID NO: 33938 - RNA, 21 nt, Artificial Sequence
  Description of Artificial Sequence: Synthetic oligonucleotide
ucuugcccauuacuuuuaauu

SEQ ID NO: 33939 - RNA, 21 nt, Artificial Sequence
  Description of Artificial Sequence: Synthetic oligonucleotide
uucuugcccauuacuuuuauu

SEQ ID NO: 33940 - RNA, 21 nt, Artificial Sequence
  Description of Artificial Sequence: Synthetic oligonucleotide
ucucuugcccauuacuuuuuu

SEQ ID NO: 33941 - RNA, 21 nt, Artificial Sequence
  Description of Artificial Sequence: Synthetic oligonucleotide
uucucuugcccauuacuuuuu

SEQ ID NO: 33942 - RNA, 21 nt, Artificial Sequence
  Description of Artificial Sequence: Synthetic oligonucleotide
uaucucuugcccauuacuuuu

SEQ ID NO: 33943 - RNA, 21 nt, Artificial Sequence
  Description of Artificial Sequence: Synthetic oligonucleotide
uaaucucuugcccauuacuuu

SEQ ID NO: 33944 - RNA, 21 nt, Artificial Sequence
  Description of Artificial Sequence: Synthetic oligonucleotide
ucaaucucuugcccauuacuu

SEQ ID NO: 33945 - RNA, 21 nt, Artificial Sequence
  Description of Artificial Sequence: Synthetic oligonucleotide
ugcaaucucuugcccauuauu

SEQ ID NO: 33946 - RNA, 21 nt, Artificial Sequence
  Description of Artificial Sequence: Synthetic oligonucleotide
uugcaaucucuugcccauuuu

SEQ ID NO: 33947 - RNA, 21 nt, Artificial Sequence
  Description of Artificial Sequence: Synthetic oligonucleotide
uaugcaaucucuugcccauuu

SEQ ID NO: 33948 - RNA, 21 nt, Artificial Sequence
  Description of Artificial Sequence: Synthetic oligonucleotide
ugaugcaaucucuugcccauu

SEQ ID NO: 33949 - RNA, 21 nt, Artificial Sequence
  Description of Artificial Sequence: Synthetic oligonucleotide
uugaugcaaucucuugcccuu

SEQ ID NO: 33950 - RNA, 21 nt, Artificial Sequence
  Description of Artificial Sequence: Synthetic oligonucleotide
uaugaugcaaucucuugccuu

SEQ ID NO: 33951 - RNA, 21 nt, Artificial Sequence
  Description of Artificial Sequence: Synthetic oligonucleotide
uuaugaugcaaucucuugcuu

SEQ ID NO: 33952 - RNA, 21 nt, Artificial Sequence
  Description of Artificial Sequence: Synthetic oligonucleotide
uguaugaugcaaucucuuguu

SEQ ID NO: 33953 - RNA, 21 nt, Artificial Sequence
  Description of Artificial Sequence: Synthetic oligonucleotide
uaguaugaugcaaucucuuuu

SEQ ID NO: 33954 - RNA, 21 nt, Artificial Sequence
  Description of Artificial Sequence: Synthetic oligonucleotide
uuaguaugaugcaaucucuuu

SEQ ID NO: 33955 - RNA, 21 nt, Artificial Sequence
  Description of Artificial Sequence: Synthetic oligonucleotide
uuuaguaugaugcaaucucuu

SEQ ID NO: 33956 - RNA, 21 nt, Artificial Sequence
  Description of Artificial Sequence: Synthetic oligonucleotide
uauuaguaugaugcaaucuuu

SEQ ID NO: 33957 - RNA, 21 nt, Artificial Sequence
  Description of Artificial Sequence: Synthetic oligonucleotide
uaauuaguaugaugcaaucuu

SEQ ID NO: 33958 - RNA, 21 nt, Artificial Sequence
  Description of Artificial Sequence: Synthetic oligonucleotide
uaaauuaguaugaugcaauuu

SEQ ID NO: 33959 - RNA, 21 nt, Artificial Sequence
  Description of Artificial Sequence: Synthetic oligonucleotide
uuaaauuaguaugaugcaauu

SEQ ID NO: 33960 - RNA, 21 nt, Artificial Sequence
  Description of Artificial Sequence: Synthetic oligonucleotide
ucuaaauuaguaugaugcauu

SEQ ID NO: 33961 - RNA, 21 nt, Artificial Sequence
  Description of Artificial Sequence: Synthetic oligonucleotide
uacuaaauuaguaugaugcuu

SEQ ID NO: 33962 - RNA, 21 nt, Artificial Sequence
  Description of Artificial Sequence: Synthetic oligonucleotide
uuacuaaauuaguaugauguu

SEQ ID NO: 33963 - RNA, 21 nt, Artificial Sequence
  Description of Artificial Sequence: Synthetic oligonucleotide
uuuacuaaauuaguaugauuu

SEQ ID NO: 33964 - RNA, 21 nt, Artificial Sequence
  Description of Artificial Sequence: Synthetic oligonucleotide
ucuuacuaaauuaguaugauu

SEQ ID NO: 33965 - RNA, 21 nt, Artificial Sequence
  Description of Artificial Sequence: Synthetic oligonucleotide
uucuuacuaaauuaguauguu

SEQ ID NO: 33966 - RNA, 21 nt, Artificial Sequence
  Description of Artificial Sequence: Synthetic oligonucleotide
uuucuuacuaaauuaguauuu

SEQ ID NO: 33967 - RNA, 21 nt, Artificial Sequence
  Description of Artificial Sequence: Synthetic oligonucleotide
uguucuuacuaaauuaguauu

SEQ ID NO: 33968 - RNA, 21 nt, Artificial Sequence
  Description of Artificial Sequence: Synthetic oligonucleotide
ucguucuuacuaaauuaguuu

SEQ ID NO: 33969 - RNA, 21 nt, Artificial Sequence
  Description of Artificial Sequence: Synthetic oligonucleotide
uacguucuuacuaaauuaguu

SEQ ID NO: 33970 - RNA, 21 nt, Artificial Sequence
  Description of Artificial Sequence: Synthetic oligonucleotide
uaacguucuuacuaaauuauu

SEQ ID NO: 33971 - RNA, 21 nt, Artificial Sequence
  Description of Artificial Sequence: Synthetic oligonucleotide
ugaacguucuuacuaaauuuu

SEQ ID NO: 33972 - RNA, 21 nt, Artificial Sequence
  Description of Artificial Sequence: Synthetic oligonucleotide
uggaacguucuuacuaaauuu

SEQ ID NO: 33973 - RNA, 21 nt, Artificial Sequence
  Description of Artificial Sequence: Synthetic oligonucleotide
ugggaacguucuuacuaaauu

SEQ ID NO: 33974 - RNA, 21 nt, Artificial Sequence
  Description of Artificial Sequence: Synthetic oligonucleotide
uugggaacguucuuacuaauu

SEQ ID NO: 33975 - RNA, 21 nt, Artificial Sequence
  Description of Artificial Sequence: Synthetic oligonucleotide
uuugggaacguucuuacuauu

SEQ ID NO: 33976 - RNA, 21 nt, Artificial Sequence
  Description of Artificial Sequence: Synthetic oligonucleotide
uuuugggaacguucuuacuuu

SEQ ID NO: 33977 - RNA, 21 nt, Artificial Sequence
  Description of Artificial Sequence: Synthetic oligonucleotide
uauuugggaacguucuuacuu

SEQ ID NO: 33978 - RNA, 21 nt, Artificial Sequence
  Description of Artificial Sequence: Synthetic oligonucleotide
ucauuugggaacguucuuauu

SEQ ID NO: 33979 - RNA, 21 nt, Artificial Sequence
  Description of Artificial Sequence: Synthetic oligonucleotide
uacauuugggaacguucuuuu

SEQ ID NO: 33980 - RNA, 21 nt, Artificial Sequence
  Description of Artificial Sequence: Synthetic oligonucleotide
uaacauuugggaacguucuuu

SEQ ID NO: 33981 - RNA, 21 nt, Artificial Sequence
  Description of Artificial Sequence: Synthetic oligonucleotide
ucaacauuugggaacguucuu

SEQ ID NO: 33982 - RNA, 21 nt, Artificial Sequence
  Description of Artificial Sequence: Synthetic oligonucleotide
uacaacauuugggaacguuuu

SEQ ID NO: 33983 - RNA, 21 nt, Artificial Sequence
  Description of Artificial Sequence: Synthetic oligonucleotide
uuacaacauuugggaacguuu

SEQ ID NO: 33984 - RNA, 21 nt, Artificial Sequence
  Description of Artificial Sequence: Synthetic oligonucleotide
uuuacaacauuugggaacguu

SEQ ID NO: 33985 - RNA, 21 nt, Artificial Sequence
  Description of Artificial Sequence: Synthetic oligonucleotide
uguuacaacauuugggaacuu

SEQ ID NO: 33986 - RNA, 21 nt, Artificial Sequence
  Description of Artificial Sequence: Synthetic oligonucleotide
uuguuacaacauuugggaauu

SEQ ID NO: 33987 - RNA, 21 nt, Artificial Sequence
  Description of Artificial Sequence: Synthetic oligonucleotide
uuuguuacaacauuugggauu

SEQ ID NO: 33988 - RNA, 21 nt, Artificial Sequence
  Description of Artificial Sequence: Synthetic oligonucleotide
uauuguuacaacauuuggguu

SEQ ID NO: 33989 - RNA, 21 nt, Artificial Sequence
  Description of Artificial Sequence: Synthetic oligonucleotide
ucauuguuacaacauuugguu

SEQ ID NO: 33990 - RNA, 21 nt, Artificial Sequence
  Description of Artificial Sequence: Synthetic oligonucleotide
uacauuguuacaacauuuguu

SEQ ID NO: 33991 - RNA, 21 nt, Artificial Sequence
  Description of Artificial Sequence: Synthetic oligonucleotide
ucacauuguuacaacauuuuu

SEQ ID NO: 33992 - RNA, 21 nt, Artificial Sequence
  Description of Artificial Sequence: Synthetic oligonucleotide
uccacauuguuacaacauuuu

SEQ ID NO: 33993 - RNA, 21 nt, Artificial Sequence
  Description of Artificial Sequence: Synthetic oligonucleotide
uuccacauuguuacaacauuu

SEQ ID NO: 33994 - RNA, 21 nt, Artificial Sequence
  Description of Artificial Sequence: Synthetic oligonucleotide
uauccacauuguuacaacauu

SEQ ID NO: 33995 - RNA, 21 nt, Artificial Sequence
  Description of Artificial Sequence: Synthetic oligonucleotide
ugauccacauuguuacaacuu

SEQ ID NO: 33996 - RNA, 21 nt, Artificial Sequence
  Description of Artificial Sequence: Synthetic oligonucleotide
uugauccacauuguuacaauu

SEQ ID NO: 33997 - RNA, 21 nt, Artificial Sequence
  Description of Artificial Sequence: Synthetic oligonucleotide
uaugauccacauuguuacauu

SEQ ID NO: 33998 - RNA, 21 nt, Artificial Sequence
  Description of Artificial Sequence: Synthetic oligonucleotide
uuaugauccacauuguuacuu

SEQ ID NO: 33999 - RNA, 21 nt, Artificial Sequence
  Description of Artificial Sequence: Synthetic oligonucleotide
uguaugauccacauuguuauu

SEQ ID NO: 34000 - RNA, 21 nt, Artificial Sequence
  Description of Artificial Sequence: Synthetic oligonucleotide
uuguaugauccacauuguuuu

SEQ ID NO: 34001 - RNA, 21 nt, Artificial Sequence
  Description of Artificial Sequence: Synthetic oligonucleotide
uauguaugauccacauuguuu

SEQ ID NO: 34002 - RNA, 21 nt, Artificial Sequence
  Description of Artificial Sequence: Synthetic oligonucleotide
ugauguaugauccacauuguu

SEQ ID NO: 34003 - RNA, 21 nt, Artificial Sequence
  Description of Artificial Sequence: Synthetic oligonucleotide
uagauguaugauccacauuuu

SEQ ID NO: 34004 - RNA, 21 nt, Artificial Sequence
  Description of Artificial Sequence: Synthetic oligonucleotide
ugagauguaugauccacauuu

SEQ ID NO: 34005 - RNA, 21 nt, Artificial Sequence
  Description of Artificial Sequence: Synthetic oligonucleotide
uagagauguaugauccacauu

SEQ ID NO: 34006 - RNA, 21 nt, Artificial Sequence
  Description of Artificial Sequence: Synthetic oligonucleotide
ucagagauguaugauccacuu

SEQ ID NO: 34007 - RNA, 21 nt, Artificial Sequence
  Description of Artificial Sequence: Synthetic oligonucleotide
uccagagauguaugauccauu

SEQ ID NO: 34008 - RNA, 21 nt, Artificial Sequence
  Description of Artificial Sequence: Synthetic oligonucleotide
uaccagagauguaugauccuu

SEQ ID NO: 34009 - RNA, 21 nt, Artificial Sequence
  Description of Artificial Sequence: Synthetic oligonucleotide
uaaccagagauguaugaucuu

SEQ ID NO: 34010 - RNA, 21 nt, Artificial Sequence
  Description of Artificial Sequence: Synthetic oligonucleotide
uaaaccagagauguaugauuu

SEQ ID NO: 34011 - RNA, 21 nt, Artificial Sequence
  Description of Artificial Sequence: Synthetic oligonucleotide
uaaaaccagagauguaugauu

SEQ ID NO: 34012 - RNA, 21 nt, Artificial Sequence
  Description of Artificial Sequence: Synthetic oligonucleotide
uaaaaaccagagauguauguu

SEQ ID NO: 34013 - RNA, 21 nt, Artificial Sequence
  Description of Artificial Sequence: Synthetic oligonucleotide
uaaaaaaccagagauguauuu

SEQ ID NO: 34014 - RNA, 21 nt, Artificial Sequence
  Description of Artificial Sequence: Synthetic oligonucleotide
uuaaaaaaccagagauguauu

SEQ ID NO: 34015 - RNA, 21 nt, Artificial Sequence
  Description of Artificial Sequence: Synthetic oligonucleotide
uuuaaaaaaccagagauguuu

SEQ ID NO: 34016 - RNA, 21 nt, Artificial Sequence
  Description of Artificial Sequence: Synthetic oligonucleotide
uuuuaaaaaaccagagauguu

SEQ ID NO: 34017 - RNA, 21 nt, Artificial Sequence
  Description of Artificial Sequence: Synthetic oligonucleotide
uauuuaaaaaaccagagauuu

SEQ ID NO: 34018 - RNA, 21 nt, Artificial Sequence
  Description of Artificial Sequence: Synthetic oligonucleotide
ucauuuaaaaaaccagagauu

SEQ ID NO: 34019 - RNA, 21 nt, Artificial Sequence
  Description of Artificial Sequence: Synthetic oligonucleotide
uacauuuaaaaaaccagaguu

SEQ ID NO: 34020 - RNA, 21 nt, Artificial Sequence
  Description of Artificial Sequence: Synthetic oligonucleotide
uuacauuuaaaaaaccagauu

SEQ ID NO: 34021 - RNA, 21 nt, Artificial Sequence
  Description of Artificial Sequence: Synthetic oligonucleotide
uauacauuuaaaaaaccaguu

SEQ ID NO: 34022 - RNA, 21 nt, Artificial Sequence
  Description of Artificial Sequence: Synthetic oligonucleotide
uaauacauuuaaaaaaccauu

SEQ ID NO: 34023 - RNA, 21 nt, Artificial Sequence
  Description of Artificial Sequence: Synthetic oligonucleotide
ucaauacauuuaaaaaaccuu

SEQ ID NO: 34024 - RNA, 21 nt, Artificial Sequence
  Description of Artificial Sequence: Synthetic oligonucleotide
uucaauacauuuaaaaaacuu

SEQ ID NO: 34025 - RNA, 21 nt, Artificial Sequence
  Description of Artificial Sequence: Synthetic oligonucleotide
ucucaauacauuuaaaaaauu

SEQ ID NO: 34026 - RNA, 21 nt, Artificial Sequence
  Description of Artificial Sequence: Synthetic oligonucleotide
uccucaauacauuuaaaaauu

SEQ ID NO: 34027 - RNA, 21 nt, Artificial Sequence
  Description of Artificial Sequence: Synthetic oligonucleotide
ugccucaauacauuuaaaauu

SEQ ID NO: 34028 - RNA, 21 nt, Artificial Sequence
  Description of Artificial Sequence: Synthetic oligonucleotide
uagccucaauacauuuaaauu

SEQ ID NO: 34029 - RNA, 21 nt, Artificial Sequence
  Description of Artificial Sequence: Synthetic oligonucleotide
uaagccucaauacauuuaauu

SEQ ID NO: 34030 - RNA, 21 nt, Artificial Sequence
  Description of Artificial Sequence: Synthetic oligonucleotide
uaaagccucaauacauuuauu

SEQ ID NO: 34031 - RNA, 21 nt, Artificial Sequence
  Description of Artificial Sequence: Synthetic oligonucleotide
ugaaagccucaauacauuuuu

SEQ ID NO: 34032 - RNA, 21 nt, Artificial Sequence
  Description of Artificial Sequence: Synthetic oligonucleotide
uagaaagccucaauacauuuu

SEQ ID NO: 34033 - RNA, 21 nt, Artificial Sequence
  Description of Artificial Sequence: Synthetic oligonucleotide
uaagaaagccucaauacauuu

SEQ ID NO: 34034 - RNA, 21 nt, Artificial Sequence
  Description of Artificial Sequence: Synthetic oligonucleotide
ucaagaaagccucaauacauu

SEQ ID NO: 34035 - RNA, 21 nt, Artificial Sequence
  Description of Artificial Sequence: Synthetic oligonucleotide
uccaagaaagccucaauacuu

SEQ ID NO: 34036 - RNA, 21 nt, Artificial Sequence
  Description of Artificial Sequence: Synthetic oligonucleotide
uaccaagaaagccucaauauu

SEQ ID NO: 34037 - RNA, 21 nt, Artificial Sequence
  Description of Artificial Sequence: Synthetic oligonucleotide
ucaccaagaaagccucaauuu

SEQ ID NO: 34038 - RNA, 21 nt, Artificial Sequence
  Description of Artificial Sequence: Synthetic oligonucleotide
uccaccaagaaagccucaauu

SEQ ID NO: 34039 - RNA, 21 nt, Artificial Sequence
  Description of Artificial Sequence: Synthetic oligonucleotide
uuccaccaagaaagccucauu

SEQ ID NO: 34040 - RNA, 21 nt, Artificial Sequence
  Description of Artificial Sequence: Synthetic oligonucleotide
uguccaccaagaaagccucuu

SEQ ID NO: 34041 - RNA, 21 nt, Artificial Sequence
  Description of Artificial Sequence: Synthetic oligonucleotide
uaguccaccaagaaagccuuu

SEQ ID NO: 34042 - RNA, 21 nt, Artificial Sequence
  Description of Artificial Sequence: Synthetic oligonucleotide
uuaguccaccaagaaagccuu

SEQ ID NO: 34043 - RNA, 21 nt, Artificial Sequence
  Description of Artificial Sequence: Synthetic oligonucleotide
ucuaguccaccaagaaagcuu

SEQ ID NO: 34044 - RNA, 21 nt, Artificial Sequence
  Description of Artificial Sequence: Synthetic oligonucleotide
uacuaguccaccaagaaaguu

SEQ ID NO: 34045 - RNA, 21 nt, Artificial Sequence
  Description of Artificial Sequence: Synthetic oligonucleotide
uuacuaguccaccaagaaauu

SEQ ID NO: 34046 - RNA, 21 nt, Artificial Sequence
  Description of Artificial Sequence: Synthetic oligonucleotide
uauacuaguccaccaagaauu

SEQ ID NO: 34047 - RNA, 21 nt, Artificial Sequence
  Description of Artificial Sequence: Synthetic oligonucleotide
uuauacuaguccaccaagauu

SEQ ID NO: 34048 - RNA, 21 nt, Artificial Sequence
  Description of Artificial Sequence: Synthetic oligonucleotide
ucuauacuaguccaccaaguu

SEQ ID NO: 34049 - RNA, 21 nt, Artificial Sequence
  Description of Artificial Sequence: Synthetic oligonucleotide
uacuauacuaguccaccaauu

SEQ ID NO: 34050 - RNA, 21 nt, Artificial Sequence
  Description of Artificial Sequence: Synthetic oligonucleotide
uuacuauacuaguccaccauu

SEQ ID NO: 34051 - RNA, 21 nt, Artificial Sequence
  Description of Artificial Sequence: Synthetic oligonucleotide
uauacuauacuaguccaccuu

SEQ ID NO: 34052 - RNA, 21 nt, Artificial Sequence
  Description of Artificial Sequence: Synthetic oligonucleotide
uuauacuauacuaguccacuu

SEQ ID NO: 34053 - RNA, 21 nt, Artificial Sequence
  Description of Artificial Sequence: Synthetic oligonucleotide
uguauacuauacuaguccauu

SEQ ID NO: 34054 - RNA, 21 nt, Artificial Sequence
  Description of Artificial Sequence: Synthetic oligonucleotide
ucguauacuauacuaguccuu

SEQ ID NO: 34055 - RNA, 21 nt, Artificial Sequence
  Description of Artificial Sequence: Synthetic oligonucleotide
uccguauacuauacuagucuu

SEQ ID NO: 34056 - RNA, 21 nt, Artificial Sequence
  Description of Artificial Sequence: Synthetic oligonucleotide
uaccguauacuauacuaguuu

SEQ ID NO: 34057 - RNA, 21 nt, Artificial Sequence
  Description of Artificial Sequence: Synthetic oligonucleotide
ugaccguauacuauacuaguu

SEQ ID NO: 34058 - RNA, 21 nt, Artificial Sequence
  Description of Artificial Sequence: Synthetic oligonucleotide
uugaccguauacuauacuauu

SEQ ID NO: 34059 - RNA, 21 nt, Artificial Sequence
  Description of Artificial Sequence: Synthetic oligonucleotide
ucugaccguauacuauacuuu

SEQ ID NO: 34060 - RNA, 21 nt, Artificial Sequence
  Description of Artificial Sequence: Synthetic oligonucleotide
uacugaccguauacuauacuu

SEQ ID NO: 34061 - RNA, 21 nt, Artificial Sequence
  Description of Artificial Sequence: Synthetic oligonucleotide
uaacugaccguauacuauauu

SEQ ID NO: 34062 - RNA, 21 nt, Artificial Sequence
  Description of Artificial Sequence: Synthetic oligonucleotide
uuaacugaccguauacuauuu

SEQ ID NO: 34063 - RNA, 21 nt, Artificial Sequence
  Description of Artificial Sequence: Synthetic oligonucleotide
uauaacugaccguauacuauu

SEQ ID NO: 34064 - RNA, 21 nt, Artificial Sequence
  Description of Artificial Sequence: Synthetic oligonucleotide
ucauaacugaccguauacuuu

SEQ ID NO: 34065 - RNA, 21 nt, Artificial Sequence
  Description of Artificial Sequence: Synthetic oligonucleotide
uacauaacugaccguauacuu

SEQ ID NO: 34066 - RNA, 21 nt, Artificial Sequence
  Description of Artificial Sequence: Synthetic oligonucleotide
ugacauaacugaccguauauu

SEQ ID NO: 34067 - RNA, 21 nt, Artificial Sequence
  Description of Artificial Sequence: Synthetic oligonucleotide
uugacauaacugaccguauuu

SEQ ID NO: 34068 - RNA, 21 nt, Artificial Sequence
  Description of Artificial Sequence: Synthetic oligonucleotide
uuugacauaacugaccguauu

SEQ ID NO: 34069 - RNA, 21 nt, Artificial Sequence
  Description of Artificial Sequence: Synthetic oligonucleotide
uauugacauaacugaccguuu

SEQ ID NO: 34070 - RNA, 21 nt, Artificial Sequence
  Description of Artificial Sequence: Synthetic oligonucleotide
ucauugacauaacugaccguu

SEQ ID NO: 34071 - RNA, 21 nt, Artificial Sequence
  Description of Artificial Sequence: Synthetic oligonucleotide
uacauugacauaacugaccuu

SEQ ID NO: 34072 - RNA, 21 nt, Artificial Sequence
  Description of Artificial Sequence: Synthetic oligonucleotide
uaacauugacauaacugacuu

SEQ ID NO: 34073 - RNA, 21 nt, Artificial Sequence
  Description of Artificial Sequence: Synthetic oligonucleotide
uaaacauugacauaacugauu

SEQ ID NO: 34074 - RNA, 21 nt, Artificial Sequence
  Description of Artificial Sequence: Synthetic oligonucleotide
ugaaacauugacauaacuguu

SEQ ID NO: 34075 - RNA, 21 nt, Artificial Sequence
  Description of Artificial Sequence: Synthetic oligonucleotide
uugaaacauugacauaacuuu

SEQ ID NO: 34076 - RNA, 21 nt, Artificial Sequence
  Description of Artificial Sequence: Synthetic oligonucleotide
uaugaaacauugacauaacuu

SEQ ID NO: 34077 - RNA, 21 nt, Artificial Sequence
  Description of Artificial Sequence: Synthetic oligonucleotide
ucaugaaacauugacauaauu

SEQ ID NO: 34078 - RNA, 21 nt, Artificial Sequence
  Description of Artificial Sequence: Synthetic oligonucleotide
uccaugaaacauugacauauu

SEQ ID NO: 34079 - RNA, 21 nt, Artificial Sequence
  Description of Artificial Sequence: Synthetic oligonucleotide
uaccaugaaacauugacauuu

SEQ ID NO: 34080 - RNA, 21 nt, Artificial Sequence
  Description of Artificial Sequence: Synthetic oligonucleotide
ugaccaugaaacauugacauu

SEQ ID NO: 34081 - RNA, 21 nt, Artificial Sequence
  Description of Artificial Sequence: Synthetic oligonucleotide
uugaccaugaaacauugacuu

SEQ ID NO: 34082 - RNA, 21 nt, Artificial Sequence
  Description of Artificial Sequence: Synthetic oligonucleotide
uuugaccaugaaacauugauu

SEQ ID NO: 34083 - RNA, 21 nt, Artificial Sequence
  Description of Artificial Sequence: Synthetic oligonucleotide
uauugaccaugaaacauuguu

SEQ ID NO: 34084 - RNA, 21 nt, Artificial Sequence
  Description of Artificial Sequence: Synthetic oligonucleotide
uuauugaccaugaaacauuuu

SEQ ID NO: 34085 - RNA, 21 nt, Artificial Sequence
  Description of Artificial Sequence: Synthetic oligonucleotide
uuuauugaccaugaaacauuu

SEQ ID NO: 34086 - RNA, 21 nt, Artificial Sequence
  Description of Artificial Sequence: Synthetic oligonucleotide
uuuuauugaccaugaaacauu

SEQ ID NO: 34087 - RNA, 21 nt, Artificial Sequence
  Description of Artificial Sequence: Synthetic oligonucleotide
uuuuuauugaccaugaaacuu

SEQ ID NO: 34088 - RNA, 21 nt, Artificial Sequence
  Description of Artificial Sequence: Synthetic oligonucleotide
uuuuuuauugaccaugaaauu

SEQ ID NO: 34089 - RNA, 21 nt, Artificial Sequence
  Description of Artificial Sequence: Synthetic oligonucleotide
ucuuuuuauugaccaugaauu

SEQ ID NO: 34090 - RNA, 21 nt, Artificial Sequence
  Description of Artificial Sequence: Synthetic oligonucleotide
uccuuuuuauugaccaugauu

SEQ ID NO: 34091 - RNA, 21 nt, Artificial Sequence
  Description of Artificial Sequence: Synthetic oligonucleotide
uuccuuuuuauugaccauguu

SEQ ID NO: 34092 - RNA, 21 nt, Artificial Sequence
  Description of Artificial Sequence: Synthetic oligonucleotide
uuuccuuuuuauugaccauuu

SEQ ID NO: 34093 - RNA, 21 nt, Artificial Sequence
  Description of Artificial Sequence: Synthetic oligonucleotide
ucuuccuuuuuauugaccauu

SEQ ID NO: 34094 - RNA, 21 nt, Artificial Sequence
  Description of Artificial Sequence: Synthetic oligonucleotide
uacuuccuuuuuauugaccuu

SEQ ID NO: 34095 - RNA, 21 nt, Artificial Sequence
  Description of Artificial Sequence: Synthetic oligonucleotide
uaacuuccuuuuuauugacuu

SEQ ID NO: 34096 - RNA, 21 nt, Artificial Sequence
  Description of Artificial Sequence: Synthetic oligonucleotide
ucaacuuccuuuuuauugauu

SEQ ID NO: 34097 - RNA, 21 nt, Artificial Sequence
  Description of Artificial Sequence: Synthetic oligonucleotide
ugcaacuuccuuuuuauuguu

SEQ ID NO: 34098 - RNA, 21 nt, Artificial Sequence
  Description of Artificial Sequence: Synthetic oligonucleotide
uugcaacuuccuuuuuauuuu

SEQ ID NO: 34099 - RNA, 21 nt, Artificial Sequence
  Description of Artificial Sequence: Synthetic oligonucleotide
uuugcaacuuccuuuuuauuu

SEQ ID NO: 34100 - RNA, 21 nt, Artificial Sequence
  Description of Artificial Sequence: Synthetic oligonucleotide
uuuugcaacuuccuuuuuauu

SEQ ID NO: 34101 - RNA, 21 nt, Artificial Sequence
  Description of Artificial Sequence: Synthetic oligonucleotide
uauuugcaacuuccuuuuuuu

SEQ ID NO: 34102 - RNA, 21 nt, Artificial Sequence
  Description of Artificial Sequence: Synthetic oligonucleotide
uaauuugcaacuuccuuuuuu

SEQ ID NO: 34103 - RNA, 21 nt, Artificial Sequence
  Description of Artificial Sequence: Synthetic oligonucleotide
ucaauuugcaacuuccuuuuu

SEQ ID NO: 34104 - RNA, 21 nt, Artificial Sequence
  Description of Artificial Sequence: Synthetic oligonucleotide
uacaauuugcaacuuccuuuu

SEQ ID NO: 34105 - RNA, 21 nt, Artificial Sequence
  Description of Artificial Sequence: Synthetic oligonucleotide
ucacaauuugcaacuuccuuu

SEQ ID NO: 34106 - RNA, 21 nt, Artificial Sequence
  Description of Artificial Sequence: Synthetic oligonucleotide
ucaggggcguggcgaggguuu

SEQ ID NO: 34107 - RNA, 21 nt, Artificial Sequence
  Description of Artificial Sequence: Synthetic oligonucleotide
ugcaggggcguggcgaggguu

SEQ ID NO: 34108 - RNA, 21 nt, Artificial Sequence
  Description of Artificial Sequence: Synthetic oligonucleotide
uagcaggggcguggcgagguu

SEQ ID NO: 34109 - RNA, 21 nt, Artificial Sequence
  Description of Artificial Sequence: Synthetic oligonucleotide
ugagcaggggcguggcgaguu

SEQ ID NO: 34110 - RNA, 21 nt, Artificial Sequence
  Description of Artificial Sequence: Synthetic oligonucleotide
uggagcaggggcguggcgauu

SEQ ID NO: 34111 - RNA, 21 nt, Artificial Sequence
  Description of Artificial Sequence: Synthetic oligonucleotide
ugggagcaggggcguggcguu

SEQ ID NO: 34112 - RNA, 21 nt, Artificial Sequence
  Description of Artificial Sequence: Synthetic oligonucleotide
uggggagcaggggcguggcuu

SEQ ID NO: 34113 - RNA, 21 nt, Artificial Sequence
  Description of Artificial Sequence: Synthetic oligonucleotide
ugggggagcaggggcgugguu

SEQ ID NO: 34114 - RNA, 21 nt, Artificial Sequence
  Description of Artificial Sequence: Synthetic oligonucleotide
ucgggggagcaggggcguguu

SEQ ID NO: 34115 - RNA, 21 nt, Artificial Sequence
  Description of Artificial Sequence: Synthetic oligonucleotide
ugcgggggagcaggggcguuu

SEQ ID NO: 34116 - RNA, 21 nt, Artificial Sequence
  Description of Artificial Sequence: Synthetic oligonucleotide
ucgcgggggagcaggggcguu

SEQ ID NO: 34117 - RNA, 21 nt, Artificial Sequence
  Description of Artificial Sequence: Synthetic oligonucleotide
uccgcgggggagcaggggcuu

SEQ ID NO: 34118 - RNA, 21 nt, Artificial Sequence
  Description of Artificial Sequence: Synthetic oligonucleotide
uaccgcgggggagcagggguu

SEQ ID NO: 34119 - RNA, 21 nt, Artificial Sequence
  Description of Artificial Sequence: Synthetic oligonucleotide
uaaccgcgggggagcaggguu

SEQ ID NO: 34120 - RNA, 21 nt, Artificial Sequence
  Description of Artificial Sequence: Synthetic oligonucleotide
ucaaccgcgggggagcagguu

SEQ ID NO: 34121 - RNA, 21 nt, Artificial Sequence
  Description of Artificial Sequence: Synthetic oligonucleotide
uccaaccgcgggggagcaguu

SEQ ID NO: 34122 - RNA, 21 nt, Artificial Sequence
  Description of Artificial Sequence: Synthetic oligonucleotide
uaccaaccgcgggggagcauu

SEQ ID NO: 34123 - RNA, 21 nt, Artificial Sequence
  Description of Artificial Sequence: Synthetic oligonucleotide
uaaccaaccgcgggggagcuu

SEQ ID NO: 34124 - RNA, 21 nt, Artificial Sequence
  Description of Artificial Sequence: Synthetic oligonucleotide
ugaaccaaccgcgggggaguu

SEQ ID NO: 34125 - RNA, 21 nt, Artificial Sequence
  Description of Artificial Sequence: Synthetic oligonucleotide
uagaaccaaccgcgggggauu

SEQ ID NO: 34126 - RNA, 21 nt, Artificial Sequence
  Description of Artificial Sequence: Synthetic oligonucleotide
uaagaaccaaccgcggggguu

SEQ ID NO: 34127 - RNA, 21 nt, Artificial Sequence
  Description of Artificial Sequence: Synthetic oligonucleotide
ugaagaaccaaccgcgggguu

SEQ ID NO: 34128 - RNA, 21 nt, Artificial Sequence
  Description of Artificial Sequence: Synthetic oligonucleotide
uggaagaaccaaccgcggguu

SEQ ID NO: 34129 - RNA, 21 nt, Artificial Sequence
  Description of Artificial Sequence: Synthetic oligonucleotide
uaggaagaaccaaccgcgguu

SEQ ID NO: 34130 - RNA, 21 nt, Artificial Sequence
  Description of Artificial Sequence: Synthetic oligonucleotide
uaaggaagaaccaaccgcguu

SEQ ID NO: 34131 - RNA, 21 nt, Artificial Sequence
  Description of Artificial Sequence: Synthetic oligonucleotide
ucaaggaagaaccaaccgcuu

SEQ ID NO: 34132 - RNA, 21 nt, Artificial Sequence
  Description of Artificial Sequence: Synthetic oligonucleotide
ugcaaggaagaaccaaccguu

SEQ ID NO: 34133 - RNA, 21 nt, Artificial Sequence
  Description of Artificial Sequence: Synthetic oligonucleotide
uagcaaggaagaaccaaccuu

SEQ ID NO: 34134 - RNA, 21 nt, Artificial Sequence
  Description of Artificial Sequence: Synthetic oligonucleotide
ugagcaaggaagaaccaacuu

SEQ ID NO: 34135 - RNA, 21 nt, Artificial Sequence
  Description of Artificial Sequence: Synthetic oligonucleotide
uagagcaaggaagaaccaauu

SEQ ID NO: 34136 - RNA, 21 nt, Artificial Sequence
  Description of Artificial Sequence: Synthetic oligonucleotide
uuagagcaaggaagaaccauu

SEQ ID NO: 34137 - RNA, 21 nt, Artificial Sequence
  Description of Artificial Sequence: Synthetic oligonucleotide
uguagagcaaggaagaaccuu

SEQ ID NO: 34138 - RNA, 21 nt, Artificial Sequence
  Description of Artificial Sequence: Synthetic oligonucleotide
uaguagagcaaggaagaacuu

SEQ ID NO: 34139 - RNA, 21 nt, Artificial Sequence
  Description of Artificial Sequence: Synthetic oligonucleotide
ugaguagagcaaggaagaauu

SEQ ID NO: 34140 - RNA, 21 nt, Artificial Sequence
  Description of Artificial Sequence: Synthetic oligonucleotide
uugaguagagcaaggaagauu

SEQ ID NO: 34141 - RNA, 21 nt, Artificial Sequence
  Description of Artificial Sequence: Synthetic oligonucleotide
uuugaguagagcaaggaaguu

SEQ ID NO: 34142 - RNA, 21 nt, Artificial Sequence
  Description of Artificial Sequence: Synthetic oligonucleotide
uguugaguagagcaaggaauu

SEQ ID NO: 34143 - RNA, 21 nt, Artificial Sequence
  Description of Artificial Sequence: Synthetic oligonucleotide
ugguugaguagagcaaggauu

SEQ ID NO: 34144 - RNA, 21 nt, Artificial Sequence
  Description of Artificial Sequence: Synthetic oligonucleotide
uggguugaguagagcaagguu

SEQ ID NO: 34145 - RNA, 21 nt, Artificial Sequence
  Description of Artificial Sequence: Synthetic oligonucleotide
uaggguugaguagagcaaguu

SEQ ID NO: 34146 - RNA, 21 nt, Artificial Sequence
  Description of Artificial Sequence: Synthetic oligonucleotide
ucaggguugaguagagcaauu

SEQ ID NO: 34147 - RNA, 21 nt, Artificial Sequence
  Description of Artificial Sequence: Synthetic oligonucleotide
uucaggguugaguagagcauu

SEQ ID NO: 34148 - RNA, 21 nt, Artificial Sequence
  Description of Artificial Sequence: Synthetic oligonucleotide
ugucaggguugaguagagcuu

SEQ ID NO: 34149 - RNA, 21 nt, Artificial Sequence
  Description of Artificial Sequence: Synthetic oligonucleotide
uggucaggguugaguagaguu

SEQ ID NO: 34150 - RNA, 21 nt, Artificial Sequence
  Description of Artificial Sequence: Synthetic oligonucleotide
uaggucaggguugaguagauu

SEQ ID NO: 34151 - RNA, 21 nt, Artificial Sequence
  Description of Artificial Sequence: Synthetic oligonucleotide
ugaggucaggguugaguaguu

SEQ ID NO: 34152 - RNA, 21 nt, Artificial Sequence
  Description of Artificial Sequence: Synthetic oligonucleotide
uagaggucaggguugaguauu

SEQ ID NO: 34153 - RNA, 21 nt, Artificial Sequence
  Description of Artificial Sequence: Synthetic oligonucleotide
uaagaggucaggguugaguuu

SEQ ID NO: 34154 - RNA, 21 nt, Artificial Sequence
  Description of Artificial Sequence: Synthetic oligonucleotide
ugaagaggucaggguugaguu

SEQ ID NO: 34155 - RNA, 21 nt, Artificial Sequence
  Description of Artificial Sequence: Synthetic oligonucleotide
uagaagaggucaggguugauu

SEQ ID NO: 34156 - RNA, 21 nt, Artificial Sequence
  Description of Artificial Sequence: Synthetic oligonucleotide
ugagaagaggucaggguuguu

SEQ ID NO: 34157 - RNA, 21 nt, Artificial Sequence
  Description of Artificial Sequence: Synthetic oligonucleotide
uagagaagaggucaggguuuu

SEQ ID NO: 34158 - RNA, 21 nt, Artificial Sequence
  Description of Artificial Sequence: Synthetic oligonucleotide
ugagagaagaggucaggguuu

SEQ ID NO: 34159 - RNA, 21 nt, Artificial Sequence
  Description of Artificial Sequence: Synthetic oligonucleotide
uagagagaagaggucaggguu

SEQ ID NO: 34160 - RNA, 21 nt, Artificial Sequence
  Description of Artificial Sequence: Synthetic oligonucleotide
ucagagagaagaggucagguu

SEQ ID NO: 34161 - RNA, 21 nt, Artificial Sequence
  Description of Artificial Sequence: Synthetic oligonucleotide
uucagagagaagaggucaguu

SEQ ID NO: 34162 - RNA, 21 nt, Artificial Sequence
  Description of Artificial Sequence: Synthetic oligonucleotide
ugucagagagaagaggucauu

SEQ ID NO: 34163 - RNA, 21 nt, Artificial Sequence
  Description of Artificial Sequence: Synthetic oligonucleotide
uagucagagagaagaggucuu

SEQ ID NO: 34164 - RNA, 21 nt, Artificial Sequence
  Description of Artificial Sequence: Synthetic oligonucleotide
ugagucagagagaagagguuu

SEQ ID NO: 34165 - RNA, 21 nt, Artificial Sequence
  Description of Artificial Sequence: Synthetic oligonucleotide
uagagucagagagaagagguu

SEQ ID NO: 34166 - RNA, 21 nt, Artificial Sequence
  Description of Artificial Sequence: Synthetic oligonucleotide
ugagagucagagagaagaguu

SEQ ID NO: 34167 - RNA, 21 nt, Artificial Sequence
  Description of Artificial Sequence: Synthetic oligonucleotide
ucgagagucagagagaagauu

SEQ ID NO: 34168 - RNA, 21 nt, Artificial Sequence
  Description of Artificial Sequence: Synthetic oligonucleotide
uucgagagucagagagaaguu

SEQ ID NO: 34169 - RNA, 21 nt, Artificial Sequence
  Description of Artificial Sequence: Synthetic oligonucleotide
ugucgagagucagagagaauu

SEQ ID NO: 34170 - RNA, 21 nt, Artificial Sequence
  Description of Artificial Sequence: Synthetic oligonucleotide
uagucgagagucagagagauu

SEQ ID NO: 34171 - RNA, 21 nt, Artificial Sequence
  Description of Artificial Sequence: Synthetic oligonucleotide
uaagucgagagucagagaguu

SEQ ID NO: 34172 - RNA, 21 nt, Artificial Sequence
  Description of Artificial Sequence: Synthetic oligonucleotide
ucaagucgagagucagagauu

SEQ ID NO: 34173 - RNA, 21 nt, Artificial Sequence
  Description of Artificial Sequence: Synthetic oligonucleotide
uacaagucgagagucagaguu

SEQ ID NO: 34174 - RNA, 21 nt, Artificial Sequence
  Description of Artificial Sequence: Synthetic oligonucleotide
ucacaagucgagagucagauu

SEQ ID NO: 34175 - RNA, 21 nt, Artificial Sequence
  Description of Artificial Sequence: Synthetic oligonucleotide
uacacaagucgagagucaguu

SEQ ID NO: 34176 - RNA, 21 nt, Artificial Sequence
  Description of Artificial Sequence: Synthetic oligonucleotide
uaacacaagucgagagucauu

SEQ ID NO: 34177 - RNA, 21 nt, Artificial Sequence
  Description of Artificial Sequence: Synthetic oligonucleotide
ugaacacaagucgagagucuu

SEQ ID NO: 34178 - RNA, 21 nt, Artificial Sequence
  Description of Artificial Sequence: Synthetic oligonucleotide
uggaacacaagucgagaguuu

SEQ ID NO: 34179 - RNA, 21 nt, Artificial Sequence
  Description of Artificial Sequence: Synthetic oligonucleotide
ugggaacacaagucgagaguu

SEQ ID NO: 34180 - RNA, 21 nt, Artificial Sequence
  Description of Artificial Sequence: Synthetic oligonucleotide
uggggaacacaagucgagauu

SEQ ID NO: 34181 - RNA, 21 nt, Artificial Sequence
  Description of Artificial Sequence: Synthetic oligonucleotide
ucggggaacacaagucgaguu

SEQ ID NO: 34182 - RNA, 21 nt, Artificial Sequence
  Description of Artificial Sequence: Synthetic oligonucleotide
ugcggggaacacaagucgauu

SEQ ID NO: 34183 - RNA, 21 nt, Artificial Sequence
  Description of Artificial Sequence: Synthetic oligonucleotide
uagcggggaacacaagucguu

SEQ ID NO: 34184 - RNA, 21 nt, Artificial Sequence
  Description of Artificial Sequence: Synthetic oligonucleotide
ugagcggggaacacaagucuu

SEQ ID NO: 34185 - RNA, 21 nt, Artificial Sequence
  Description of Artificial Sequence: Synthetic oligonucleotide
uggagcggggaacacaaguuu

SEQ ID NO: 34186 - RNA, 21 nt, Artificial Sequence
  Description of Artificial Sequence: Synthetic oligonucleotide
uaggagcggggaacacaaguu

SEQ ID NO: 34187 - RNA, 21 nt, Artificial Sequence
  Description of Artificial Sequence: Synthetic oligonucleotide
ugaggagcggggaacacaauu

SEQ ID NO: 34188 - RNA, 21 nt, Artificial Sequence
  Description of Artificial Sequence: Synthetic oligonucleotide
uggaggagcggggaacacauu

SEQ ID NO: 34189 - RNA, 21 nt, Artificial Sequence
  Description of Artificial Sequence: Synthetic oligonucleotide
ugggaggagcggggaacacuu

SEQ ID NO: 34190 - RNA, 21 nt, Artificial Sequence
  Description of Artificial Sequence: Synthetic oligonucleotide
uagggaggagcggggaacauu

SEQ ID NO: 34191 - RNA, 21 nt, Artificial Sequence
  Description of Artificial Sequence: Synthetic oligonucleotide
ucagggaggagcggggaacuu

SEQ ID NO: 34192 - RNA, 21 nt, Artificial Sequence
  Description of Artificial Sequence: Synthetic oligonucleotide
uucagggaggagcggggaauu

SEQ ID NO: 34193 - RNA, 21 nt, Artificial Sequence
  Description of Artificial Sequence: Synthetic oligonucleotide
ugucagggaggagcggggauu

SEQ ID NO: 34194 - RNA, 21 nt, Artificial Sequence
  Description of Artificial Sequence: Synthetic oligonucleotide
uggucagggaggagcgggguu

SEQ ID NO: 34195 - RNA, 21 nt, Artificial Sequence
  Description of Artificial Sequence: Synthetic oligonucleotide
uaggucagggaggagcggguu

SEQ ID NO: 34196 - RNA, 21 nt, Artificial Sequence
  Description of Artificial Sequence: Synthetic oligonucleotide
uaaggucagggaggagcgguu

SEQ ID NO: 34197 - RNA, 21 nt, Artificial Sequence
  Description of Artificial Sequence: Synthetic oligonucleotide
ugaaggucagggaggagcguu

SEQ ID NO: 34198 - RNA, 21 nt, Artificial Sequence
  Description of Artificial Sequence: Synthetic oligonucleotide
uggaaggucagggaggagcuu

SEQ ID NO: 34199 - RNA, 21 nt, Artificial Sequence
  Description of Artificial Sequence: Synthetic oligonucleotide
uaggaaggucagggaggaguu

SEQ ID NO: 34200 - RNA, 21 nt, Artificial Sequence
  Description of Artificial Sequence: Synthetic oligonucleotide
ugaggaaggucagggaggauu

SEQ ID NO: 34201 - RNA, 21 nt, Artificial Sequence
  Description of Artificial Sequence: Synthetic oligonucleotide
uggaggaaggucagggagguu

SEQ ID NO: 34202 - RNA, 21 nt, Artificial Sequence
  Description of Artificial Sequence: Synthetic oligonucleotide
ugggaggaaggucagggaguu

SEQ ID NO: 34203 - RNA, 21 nt, Artificial Sequence
  Description of Artificial Sequence: Synthetic oligonucleotide
uggggaggaaggucagggauu

SEQ ID NO: 34204 - RNA, 21 nt, Artificial Sequence
  Description of Artificial Sequence: Synthetic oligonucleotide
uaggggaggaaggucaggguu

SEQ ID NO: 34205 - RNA, 21 nt, Artificial Sequence
  Description of Artificial Sequence: Synthetic oligonucleotide
ugaggggaggaaggucagguu

SEQ ID NO: 34206 - RNA, 21 nt, Artificial Sequence
  Description of Artificial Sequence: Synthetic oligonucleotide
uggaggggaggaaggucaguu

SEQ ID NO: 34207 - RNA, 21 nt, Artificial Sequence
  Description of Artificial Sequence: Synthetic oligonucleotide
ugggaggggaggaaggucauu

SEQ ID NO: 34208 - RNA, 21 nt, Artificial Sequence
  Description of Artificial Sequence: Synthetic oligonucleotide
uggggaggggaggaaggucuu

SEQ ID NO: 34209 - RNA, 21 nt, Artificial Sequence
  Description of Artificial Sequence: Synthetic oligonucleotide
uaggggaggggaggaagguuu

SEQ ID NO: 34210 - RNA, 21 nt, Artificial Sequence
  Description of Artificial Sequence: Synthetic oligonucleotide
uaaggggaggggaggaagguu

SEQ ID NO: 34211 - RNA, 21 nt, Artificial Sequence
  Description of Artificial Sequence: Synthetic oligonucleotide
uaaaggggaggggaggaaguu

SEQ ID NO: 34212 - RNA, 21 nt, Artificial Sequence
  Description of Artificial Sequence: Synthetic oligonucleotide
ugaaaggggaggggaggaauu

SEQ ID NO: 34213 - RNA, 21 nt, Artificial Sequence
  Description of Artificial Sequence: Synthetic oligonucleotide
uugaaaggggaggggaggauu

SEQ ID NO: 34214 - RNA, 21 nt, Artificial Sequence
  Description of Artificial Sequence: Synthetic oligonucleotide
ugugaaaggggaggggagguu

SEQ ID NO: 34215 - RNA, 21 nt, Artificial Sequence
  Description of Artificial Sequence: Synthetic oligonucleotide
uagugaaaggggaggggaguu

SEQ ID NO: 34216 - RNA, 21 nt, Artificial Sequence
  Description of Artificial Sequence: Synthetic oligonucleotide
ugagugaaaggggaggggauu

SEQ ID NO: 34217 - RNA, 21 nt, Artificial Sequence
  Description of Artificial Sequence: Synthetic oligonucleotide
uugagugaaaggggagggguu

SEQ ID NO: 34218 - RNA, 21 nt, Artificial Sequence
  Description of Artificial Sequence: Synthetic oligonucleotide
uuugagugaaaggggaggguu

SEQ ID NO: 34219 - RNA, 21 nt, Artificial Sequence
  Description of Artificial Sequence: Synthetic oligonucleotide
uauugagugaaaggggagguu

SEQ ID NO: 34220 - RNA, 21 nt, Artificial Sequence
  Description of Artificial Sequence: Synthetic oligonucleotide
uaauugagugaaaggggaguu

SEQ ID NO: 34221 - RNA, 21 nt, Artificial Sequence
  Description of Artificial Sequence: Synthetic oligonucleotide
ugaauugagugaaaggggauu

SEQ ID NO: 34222 - RNA, 21 nt, Artificial Sequence
  Description of Artificial Sequence: Synthetic oligonucleotide
uagaauugagugaaagggguu

SEQ ID NO: 34223 - RNA, 21 nt, Artificial Sequence
  Description of Artificial Sequence: Synthetic oligonucleotide
ugagaauugagugaaaggguu

SEQ ID NO: 34224 - RNA, 21 nt, Artificial Sequence
  Description of Artificial Sequence: Synthetic oligonucleotide
uugagaauugagugaaagguu

SEQ ID NO: 34225 - RNA, 21 nt, Artificial Sequence
  Description of Artificial Sequence: Synthetic oligonucleotide
ugugagaauugagugaaaguu

SEQ ID NO: 34226 - RNA, 21 nt, Artificial Sequence
  Description of Artificial Sequence: Synthetic oligonucleotide
uggugagaauugagugaaauu

SEQ ID NO: 34227 - RNA, 21 nt, Artificial Sequence
  Description of Artificial Sequence: Synthetic oligonucleotide
uuggugagaauugagugaauu

SEQ ID NO: 34228 - RNA, 21 nt, Artificial Sequence
  Description of Artificial Sequence: Synthetic oligonucleotide
uuuggugagaauugagugauu

SEQ ID NO: 34229 - RNA, 21 nt, Artificial Sequence
  Description of Artificial Sequence: Synthetic oligonucleotide
uguuggugagaauugaguguu

SEQ ID NO: 34230 - RNA, 21 nt, Artificial Sequence
  Description of Artificial Sequence: Synthetic oligonucleotide
uaguuggugagaauugaguuu

SEQ ID NO: 34231 - RNA, 21 nt, Artificial Sequence
  Description of Artificial Sequence: Synthetic oligonucleotide
ugaguuggugagaauugaguu

SEQ ID NO: 34232 - RNA, 21 nt, Artificial Sequence
  Description of Artificial Sequence: Synthetic oligonucleotide
uagaguuggugagaauugauu

SEQ ID NO: 34233 - RNA, 21 nt, Artificial Sequence
  Description of Artificial Sequence: Synthetic oligonucleotide
uaagaguuggugagaauuguu

SEQ ID NO: 34234 - RNA, 21 nt, Artificial Sequence
  Description of Artificial Sequence: Synthetic oligonucleotide
uaaagaguuggugagaauuuu

SEQ ID NO: 34235 - RNA, 21 nt, Artificial Sequence
  Description of Artificial Sequence: Synthetic oligonucleotide
ugaaagaguuggugagaauuu

SEQ ID NO: 34236 - RNA, 21 nt, Artificial Sequence
  Description of Artificial Sequence: Synthetic oligonucleotide
uagaaagaguuggugagaauu

SEQ ID NO: 34237 - RNA, 21 nt, Artificial Sequence
  Description of Artificial Sequence: Synthetic oligonucleotide
ugagaaagaguuggugagauu

SEQ ID NO: 34238 - RNA, 21 nt, Artificial Sequence
  Description of Artificial Sequence: Synthetic oligonucleotide
uagagaaagaguuggugaguu

SEQ ID NO: 34239 - RNA, 21 nt, Artificial Sequence
  Description of Artificial Sequence: Synthetic oligonucleotide
ugagagaaagaguuggugauu

SEQ ID NO: 34240 - RNA, 21 nt, Artificial Sequence
  Description of Artificial Sequence: Synthetic oligonucleotide
uagagagaaagaguugguguu

SEQ ID NO: 34241 - RNA, 21 nt, Artificial Sequence
  Description of Artificial Sequence: Synthetic oligonucleotide
ugagagagaaagaguugguuu

SEQ ID NO: 34242 - RNA, 21 nt, Artificial Sequence
  Description of Artificial Sequence: Synthetic oligonucleotide
uagagagagaaagaguugguu

SEQ ID NO: 34243 - RNA, 21 nt, Artificial Sequence
  Description of Artificial Sequence: Synthetic oligonucleotide
ucagagagagaaagaguuguu

SEQ ID NO: 34244 - RNA, 21 nt, Artificial Sequence
  Description of Artificial Sequence: Synthetic oligonucleotide
uccagagagagaaagaguuuu

SEQ ID NO: 34245 - RNA, 21 nt, Artificial Sequence
  Description of Artificial Sequence: Synthetic oligonucleotide
uaccagagagagaaagaguuu

SEQ ID NO: 34246 - RNA, 21 nt, Artificial Sequence
  Description of Artificial Sequence: Synthetic oligonucleotide
ucaccagagagagaaagaguu

SEQ ID NO: 34247 - RNA, 21 nt, Artificial Sequence
  Description of Artificial Sequence: Synthetic oligonucleotide
uacaccagagagagaaagauu

SEQ ID NO: 34248 - RNA, 21 nt, Artificial Sequence
  Description of Artificial Sequence: Synthetic oligonucleotide
uaacaccagagagagaaaguu

SEQ ID NO: 34249 - RNA, 21 nt, Artificial Sequence
  Description of Artificial Sequence: Synthetic oligonucleotide
uaaacaccagagagagaaauu

SEQ ID NO: 34250 - RNA, 21 nt, Artificial Sequence
  Description of Artificial Sequence: Synthetic oligonucleotide
uaaaacaccagagagagaauu

SEQ ID NO: 34251 - RNA, 21 nt, Artificial Sequence
  Description of Artificial Sequence: Synthetic oligonucleotide
ugaaaacaccagagagagauu

SEQ ID NO: 34252 - RNA, 21 nt, Artificial Sequence
  Description of Artificial Sequence: Synthetic oligonucleotide
uagaaaacaccagagagaguu

SEQ ID NO: 34253 - RNA, 21 nt, Artificial Sequence
  Description of Artificial Sequence: Synthetic oligonucleotide
ugagaaaacaccagagagauu

SEQ ID NO: 34254 - RNA, 21 nt, Artificial Sequence
  Description of Artificial Sequence: Synthetic oligonucleotide
uggagaaaacaccagagaguu

SEQ ID NO: 34255 - RNA, 21 nt, Artificial Sequence
  Description of Artificial Sequence: Synthetic oligonucleotide
uaggagaaaacaccagagauu

SEQ ID NO: 34256 - RNA, 21 nt, Artificial Sequence
  Description of Artificial Sequence: Synthetic oligonucleotide
uaaggagaaaacaccagaguu

SEQ ID NO: 34257 - RNA, 21 nt, Artificial Sequence
  Description of Artificial Sequence: Synthetic oligonucleotide
uaaaggagaaaacaccagauu

SEQ ID NO: 34258 - RNA, 21 nt, Artificial Sequence
  Description of Artificial Sequence: Synthetic oligonucleotide
uaaaaggagaaaacaccaguu

SEQ ID NO: 34259 - RNA, 21 nt, Artificial Sequence
  Description of Artificial Sequence: Synthetic oligonucleotide
ugaaaaggagaaaacaccauu

SEQ ID NO: 34260 - RNA, 21 nt, Artificial Sequence
  Description of Artificial Sequence: Synthetic oligonucleotide
uagaaaaggagaaaacaccuu

SEQ ID NO: 34261 - RNA, 21 nt, Artificial Sequence
  Description of Artificial Sequence: Synthetic oligonucleotide
ugagaaaaggagaaaacacuu

SEQ ID NO: 34262 - RNA, 21 nt, Artificial Sequence
  Description of Artificial Sequence: Synthetic oligonucleotide
ucgagaaaaggagaaaacauu

SEQ ID NO: 34263 - RNA, 21 nt, Artificial Sequence
  Description of Artificial Sequence: Synthetic oligonucleotide
uacgagaaaaggagaaaacuu

SEQ ID NO: 34264 - RNA, 21 nt, Artificial Sequence
  Description of Artificial Sequence: Synthetic oligonucleotide
uuacgagaaaaggagaaaauu

SEQ ID NO: 34265 - RNA, 21 nt, Artificial Sequence
  Description of Artificial Sequence: Synthetic oligonucleotide
uuuacgagaaaaggagaaauu

SEQ ID NO: 34266 - RNA, 21 nt, Artificial Sequence
  Description of Artificial Sequence: Synthetic oligonucleotide
uuuuacgagaaaaggagaauu

SEQ ID NO: 34267 - RNA, 21 nt, Artificial Sequence
  Description of Artificial Sequence: Synthetic oligonucleotide
uguuuacgagaaaaggagauu

SEQ ID NO: 34268 - RNA, 21 nt, Artificial Sequence
  Description of Artificial Sequence: Synthetic oligonucleotide
uaguuuacgagaaaaggaguu

SEQ ID NO: 34269 - RNA, 21 nt, Artificial Sequence
  Description of Artificial Sequence: Synthetic oligonucleotide
uaaguuuacgagaaaaggauu

SEQ ID NO: 34270 - RNA, 21 nt, Artificial Sequence
  Description of Artificial Sequence: Synthetic oligonucleotide
uaaaguuuacgagaaaagguu

SEQ ID NO: 34271 - RNA, 21 nt, Artificial Sequence
  Description of Artificial Sequence: Synthetic oligonucleotide
ucaaaguuuacgagaaaaguu

SEQ ID NO: 34272 - RNA, 21 nt, Artificial Sequence
  Description of Artificial Sequence: Synthetic oligonucleotide
ugcaaaguuuacgagaaaauu

SEQ ID NO: 34273 - RNA, 21 nt, Artificial Sequence
  Description of Artificial Sequence: Synthetic oligonucleotide
uggcaaaguuuacgagaaauu

SEQ ID NO: 34274 - RNA, 21 nt, Artificial Sequence
  Description of Artificial Sequence: Synthetic oligonucleotide
ucggcaaaguuuacgagaauu

SEQ ID NO: 34275 - RNA, 21 nt, Artificial Sequence
  Description of Artificial Sequence: Synthetic oligonucleotide
ugcggcaaaguuuacgagauu

SEQ ID NO: 34276 - RNA, 21 nt, Artificial Sequence
  Description of Artificial Sequence: Synthetic oligonucleotide
uggcggcaaaguuuacgaguu

SEQ ID NO: 34277 - RNA, 21 nt, Artificial Sequence
  Description of Artificial Sequence: Synthetic oligonucleotide
uaggcggcaaaguuuacgauu

SEQ ID NO: 34278 - RNA, 21 nt, Artificial Sequence
  Description of Artificial Sequence: Synthetic oligonucleotide
uuaggcggcaaaguuuacguu

SEQ ID NO: 34279 - RNA, 21 nt, Artificial Sequence
  Description of Artificial Sequence: Synthetic oligonucleotide
uauaggcggcaaaguuuacuu

SEQ ID NO: 34280 - RNA, 21 nt, Artificial Sequence
  Description of Artificial Sequence: Synthetic oligonucleotide
ucauaggcggcaaaguuuauu

SEQ ID NO: 34281 - RNA, 21 nt, Artificial Sequence
  Description of Artificial Sequence: Synthetic oligonucleotide
uucauaggcggcaaaguuuuu

SEQ ID NO: 34282 - RNA, 21 nt, Artificial Sequence
  Description of Artificial Sequence: Synthetic oligonucleotide
ucucauaggcggcaaaguuuu

SEQ ID NO: 34283 - RNA, 21 nt, Artificial Sequence
  Description of Artificial Sequence: Synthetic oligonucleotide
ugcucauaggcggcaaaguuu

SEQ ID NO: 34284 - RNA, 21 nt, Artificial Sequence
  Description of Artificial Sequence: Synthetic oligonucleotide
uugcucauaggcggcaaaguu

SEQ ID NO: 34285 - RNA, 21 nt, Artificial Sequence
  Description of Artificial Sequence: Synthetic oligonucleotide
ucugcucauaggcggcaaauu

SEQ ID NO: 34286 - RNA, 21 nt, Artificial Sequence
  Description of Artificial Sequence: Synthetic oligonucleotide
ugcugcucauaggcggcaauu

SEQ ID NO: 34287 - RNA, 21 nt, Artificial Sequence
  Description of Artificial Sequence: Synthetic oligonucleotide
uggcugcucauaggcggcauu

SEQ ID NO: 34288 - RNA, 21 nt, Artificial Sequence
  Description of Artificial Sequence: Synthetic oligonucleotide
uuggcugcucauaggcggcuu

SEQ ID NO: 34289 - RNA, 21 nt, Artificial Sequence
  Description of Artificial Sequence: Synthetic oligonucleotide
uguggcugcucauaggcgguu

SEQ ID NO: 34290 - RNA, 21 nt, Artificial Sequence
  Description of Artificial Sequence: Synthetic oligonucleotide
uuguggcugcucauaggcguu

SEQ ID NO: 34291 - RNA, 21 nt, Artificial Sequence
  Description of Artificial Sequence: Synthetic oligonucleotide
uauguggcugcucauaggcuu

SEQ ID NO: 34292 - RNA, 21 nt, Artificial Sequence
  Description of Artificial Sequence: Synthetic oligonucleotide
uaauguggcugcucauagguu

SEQ ID NO: 34293 - RNA, 21 nt, Artificial Sequence
  Description of Artificial Sequence: Synthetic oligonucleotide
ucaauguggcugcucauaguu

SEQ ID NO: 34294 - RNA, 21 nt, Artificial Sequence
  Description of Artificial Sequence: Synthetic oligonucleotide
ugcaauguggcugcucauauu

SEQ ID NO: 34295 - RNA, 21 nt, Artificial Sequence
  Description of Artificial Sequence: Synthetic oligonucleotide
uggcaauguggcugcucauuu

SEQ ID NO: 34296 - RNA, 21 nt, Artificial Sequence
  Description of Artificial Sequence: Synthetic oligonucleotide
uaggcaauguggcugcucauu

SEQ ID NO: 34297 - RNA, 21 nt, Artificial Sequence
  Description of Artificial Sequence: Synthetic oligonucleotide
uaaggcaauguggcugcucuu

SEQ ID NO: 34298 - RNA, 21 nt, Artificial Sequence
  Description of Artificial Sequence: Synthetic oligonucleotide
uuaaggcaauguggcugcuuu

SEQ ID NO: 34299 - RNA, 21 nt, Artificial Sequence
  Description of Artificial Sequence: Synthetic oligonucleotide
uguaaggcaauguggcugcuu

SEQ ID NO: 34300 - RNA, 21 nt, Artificial Sequence
  Description of Artificial Sequence: Synthetic oligonucleotide
uaguaaggcaauguggcuguu

SEQ ID NO: 34301 - RNA, 21 nt, Artificial Sequence
  Description of Artificial Sequence: Synthetic oligonucleotide
ucaguaaggcaauguggcuuu

SEQ ID NO: 34302 - RNA, 21 nt, Artificial Sequence
  Description of Artificial Sequence: Synthetic oligonucleotide
ucaggggcguggcgaggguuu

SEQ ID NO: 34303 - RNA, 21 nt, Artificial Sequence
  Description of Artificial Sequence: Synthetic oligonucleotide
ugcaggggcguggcgaggguu

SEQ ID NO: 34304 - RNA, 21 nt, Artificial Sequence
  Description of Artificial Sequence: Synthetic oligonucleotide
uagcaggggcguggcgagguu

SEQ ID NO: 34305 - RNA, 21 nt, Artificial Sequence
  Description of Artificial Sequence: Synthetic oligonucleotide
ugagcaggggcguggcgaguu

SEQ ID NO: 34306 - RNA, 21 nt, Artificial Sequence
  Description of Artificial Sequence: Synthetic oligonucleotide
uggagcaggggcguggcgauu

SEQ ID NO: 34307 - RNA, 21 nt, Artificial Sequence
  Description of Artificial Sequence: Synthetic oligonucleotide
ugggagcaggggcguggcguu

SEQ ID NO: 34308 - RNA, 21 nt, Artificial Sequence
  Description of Artificial Sequence: Synthetic oligonucleotide
uggggagcaggggcguggcuu

SEQ ID NO: 34309 - RNA, 21 nt, Artificial Sequence
  Description of Artificial Sequence: Synthetic oligonucleotide
ugggggagcaggggcgugguu

SEQ ID NO: 34310 - RNA, 21 nt, Artificial Sequence
  Description of Artificial Sequence: Synthetic oligonucleotide
ucgggggagcaggggcguguu

SEQ ID NO: 34311 - RNA, 21 nt, Artificial Sequence
  Description of Artificial Sequence: Synthetic oligonucleotide
ugcgggggagcaggggcguuu

SEQ ID NO: 34312 - RNA, 21 nt, Artificial Sequence
  Description of Artificial Sequence: Synthetic oligonucleotide
ucgcgggggagcaggggcguu

SEQ ID NO: 34313 - RNA, 21 nt, Artificial Sequence
  Description of Artificial Sequence: Synthetic oligonucleotide
uccgcgggggagcaggggcuu

SEQ ID NO: 34314 - RNA, 21 nt, Artificial Sequence
  Description of Artificial Sequence: Synthetic oligonucleotide
uaccgcgggggagcagggguu

SEQ ID NO: 34315 - RNA, 21 nt, Artificial Sequence
  Description of Artificial Sequence: Synthetic oligonucleotide
uaaccgcgggggagcaggguu

SEQ ID NO: 34316 - RNA, 21 nt, Artificial Sequence
  Description of Artificial Sequence: Synthetic oligonucleotide
ucaaccgcgggggagcagguu

SEQ ID NO: 34317 - RNA, 21 nt, Artificial Sequence
  Description of Artificial Sequence: Synthetic oligonucleotide
uccaaccgcgggggagcaguu

SEQ ID NO: 34318 - RNA, 21 nt, Artificial Sequence
  Description of Artificial Sequence: Synthetic oligonucleotide
uaccaaccgcgggggagcauu

SEQ ID NO: 34319 - RNA, 21 nt, Artificial Sequence
  Description of Artificial Sequence: Synthetic oligonucleotide
uaaccaaccgcgggggagcuu

SEQ ID NO: 34320 - RNA, 21 nt, Artificial Sequence
  Description of Artificial Sequence: Synthetic oligonucleotide
ugaaccaaccgcgggggaguu

SEQ ID NO: 34321 - RNA, 21 nt, Artificial Sequence
  Description of Artificial Sequence: Synthetic oligonucleotide
uagaaccaaccgcgggggauu

SEQ ID NO: 34322 - RNA, 21 nt, Artificial Sequence
  Description of Artificial Sequence: Synthetic oligonucleotide
uaagaaccaaccgcggggguu

SEQ ID NO: 34323 - RNA, 21 nt, Artificial Sequence
  Description of Artificial Sequence: Synthetic oligonucleotide
ugaagaaccaaccgcgggguu

SEQ ID NO: 34324 - RNA, 21 nt, Artificial Sequence
  Description of Artificial Sequence: Synthetic oligonucleotide
uggaagaaccaaccgcggguu

SEQ ID NO: 34325 - RNA, 21 nt, Artificial Sequence
  Description of Artificial Sequence: Synthetic oligonucleotide
uaggaagaaccaaccgcgguu

SEQ ID NO: 34326 - RNA, 21 nt, Artificial Sequence
  Description of Artificial Sequence: Synthetic oligonucleotide
uaaggaagaaccaaccgcguu

SEQ ID NO: 34327 - RNA, 21 nt, Artificial Sequence
  Description of Artificial Sequence: Synthetic oligonucleotide
ucaaggaagaaccaaccgcuu

SEQ ID NO: 34328 - RNA, 21 nt, Artificial Sequence
  Description of Artificial Sequence: Synthetic oligonucleotide
ugcaaggaagaaccaaccguu

SEQ ID NO: 34329 - RNA, 21 nt, Artificial Sequence
  Description of Artificial Sequence: Synthetic oligonucleotide
uagcaaggaagaaccaaccuu

SEQ ID NO: 34330 - RNA, 21 nt, Artificial Sequence
  Description of Artificial Sequence: Synthetic oligonucleotide
ugagcaaggaagaaccaacuu

SEQ ID NO: 34331 - RNA, 21 nt, Artificial Sequence
  Description of Artificial Sequence: Synthetic oligonucleotide
uagagcaaggaagaaccaauu

SEQ ID NO: 34332 - RNA, 21 nt, Artificial Sequence
  Description of Artificial Sequence: Synthetic oligonucleotide
uuagagcaaggaagaaccauu

SEQ ID NO: 34333 - RNA, 21 nt, Artificial Sequence
  Description of Artificial Sequence: Synthetic oligonucleotide
uguagagcaaggaagaaccuu

SEQ ID NO: 34334 - RNA, 21 nt, Artificial Sequence
  Description of Artificial Sequence: Synthetic oligonucleotide
uaguagagcaaggaagaacuu

SEQ ID NO: 34335 - RNA, 21 nt, Artificial Sequence
  Description of Artificial Sequence: Synthetic oligonucleotide
ugaguagagcaaggaagaauu

SEQ ID NO: 34336 - RNA, 21 nt, Artificial Sequence
  Description of Artificial Sequence: Synthetic oligonucleotide
uugaguagagcaaggaagauu

SEQ ID NO: 34337 - RNA, 21 nt, Artificial Sequence
  Description of Artificial Sequence: Synthetic oligonucleotide
uuugaguagagcaaggaaguu

SEQ ID NO: 34338 - RNA, 21 nt, Artificial Sequence
  Description of Artificial Sequence: Synthetic oligonucleotide
uguugaguagagcaaggaauu

SEQ ID NO: 34339 - RNA, 21 nt, Artificial Sequence
  Description of Artificial Sequence: Synthetic oligonucleotide
ugguugaguagagcaaggauu

SEQ ID NO: 34340 - RNA, 21 nt, Artificial Sequence
  Description of Artificial Sequence: Synthetic oligonucleotide
uggguugaguagagcaagguu

SEQ ID NO: 34341 - RNA, 21 nt, Artificial Sequence
  Description of Artificial Sequence: Synthetic oligonucleotide
uaggguugaguagagcaaguu

SEQ ID NO: 34342 - RNA, 21 nt, Artificial Sequence
  Description of Artificial Sequence: Synthetic oligonucleotide
ucaggguugaguagagcaauu

SEQ ID NO: 34343 - RNA, 21 nt, Artificial Sequence
  Description of Artificial Sequence: Synthetic oligonucleotide
uucaggguugaguagagcauu

SEQ ID NO: 34344 - RNA, 21 nt, Artificial Sequence
  Description of Artificial Sequence: Synthetic oligonucleotide
ugucaggguugaguagagcuu

SEQ ID NO: 34345 - RNA, 21 nt, Artificial Sequence
  Description of Artificial Sequence: Synthetic oligonucleotide
uggucaggguugaguagaguu

SEQ ID NO: 34346 - RNA, 21 nt, Artificial Sequence
  Description of Artificial Sequence: Synthetic oligonucleotide
uaggucaggguugaguagauu

SEQ ID NO: 34347 - RNA, 21 nt, Artificial Sequence
  Description of Artificial Sequence: Synthetic oligonucleotide
ugaggucaggguugaguaguu

SEQ ID NO: 34348 - RNA, 21 nt, Artificial Sequence
  Description of Artificial Sequence: Synthetic oligonucleotide
uagaggucaggguugaguauu

SEQ ID NO: 34349 - RNA, 21 nt, Artificial Sequence
  Description of Artificial Sequence: Synthetic oligonucleotide
uaagaggucaggguugaguuu

SEQ ID NO: 34350 - RNA, 21 nt, Artificial Sequence
  Description of Artificial Sequence: Synthetic oligonucleotide
ugaagaggucaggguugaguu

SEQ ID NO: 34351 - RNA, 21 nt, Artificial Sequence
  Description of Artificial Sequence: Synthetic oligonucleotide
uagaagaggucaggguugauu

SEQ ID NO: 34352 - RNA, 21 nt, Artificial Sequence
  Description of Artificial Sequence: Synthetic oligonucleotide
ugagaagaggucaggguuguu

SEQ ID NO: 34353 - RNA, 21 nt, Artificial Sequence
  Description of Artificial Sequence: Synthetic oligonucleotide
uagagaagaggucaggguuuu

SEQ ID NO: 34354 - RNA, 21 nt, Artificial Sequence
  Description of Artificial Sequence: Synthetic oligonucleotide
ugagagaagaggucaggguuu

SEQ ID NO: 34355 - RNA, 21 nt, Artificial Sequence
  Description of Artificial Sequence: Synthetic oligonucleotide
uagagagaagaggucaggguu

SEQ ID NO: 34356 - RNA, 21 nt, Artificial Sequence
  Description of Artificial Sequence: Synthetic oligonucleotide
ucagagagaagaggucagguu

SEQ ID NO: 34357 - RNA, 21 nt, Artificial Sequence
  Description of Artificial Sequence: Synthetic oligonucleotide
uucagagagaagaggucaguu

SEQ ID NO: 34358 - RNA, 21 nt, Artificial Sequence
  Description of Artificial Sequence: Synthetic oligonucleotide
ugucagagagaagaggucauu

SEQ ID NO: 34359 - RNA, 21 nt, Artificial Sequence
  Description of Artificial Sequence: Synthetic oligonucleotide
uagucagagagaagaggucuu

SEQ ID NO: 34360 - RNA, 21 nt, Artificial Sequence
  Description of Artificial Sequence: Synthetic oligonucleotide
ugagucagagagaagagguuu

SEQ ID NO: 34361 - RNA, 21 nt, Artificial Sequence
  Description of Artificial Sequence: Synthetic oligonucleotide
uagagucagagagaagagguu

SEQ ID NO: 34362 - RNA, 21 nt, Artificial Sequence
  Description of Artificial Sequence: Synthetic oligonucleotide
ugagagucagagagaagaguu

SEQ ID NO: 34363 - RNA, 21 nt, Artificial Sequence
  Description of Artificial Sequence: Synthetic oligonucleotide
ucgagagucagagagaagauu

SEQ ID NO: 34364 - RNA, 21 nt, Artificial Sequence
  Description of Artificial Sequence: Synthetic oligonucleotide
uucgagagucagagagaaguu

SEQ ID NO: 34365 - RNA, 21 nt, Artificial Sequence
  Description of Artificial Sequence: Synthetic oligonucleotide
ugucgagagucagagagaauu

SEQ ID NO: 34366 - RNA, 21 nt, Artificial Sequence
  Description of Artificial Sequence: Synthetic oligonucleotide
uagucgagagucagagagauu

SEQ ID NO: 34367 - RNA, 21 nt, Artificial Sequence
  Description of Artificial Sequence: Synthetic oligonucleotide
uaagucgagagucagagaguu

SEQ ID NO: 34368 - RNA, 21 nt, Artificial Sequence
  Description of Artificial Sequence: Synthetic oligonucleotide
ucaagucgagagucagagauu

SEQ ID NO: 34369 - RNA, 21 nt, Artificial Sequence
  Description of Artificial Sequence: Synthetic oligonucleotide
uacaagucgagagucagaguu

SEQ ID NO: 34370 - RNA, 21 nt, Artificial Sequence
  Description of Artificial Sequence: Synthetic oligonucleotide
ucacaagucgagagucagauu

SEQ ID NO: 34371 - RNA, 21 nt, Artificial Sequence
  Description of Artificial Sequence: Synthetic oligonucleotide
uacacaagucgagagucaguu

SEQ ID NO: 34372 - RNA, 21 nt, Artificial Sequence
  Description of Artificial Sequence: Synthetic oligonucleotide
uaacacaagucgagagucauu

SEQ ID NO: 34373 - RNA, 21 nt, Artificial Sequence
  Description of Artificial Sequence: Synthetic oligonucleotide
ugaacacaagucgagagucuu

SEQ ID NO: 34374 - RNA, 21 nt, Artificial Sequence
  Description of Artificial Sequence: Synthetic oligonucleotide
uggaacacaagucgagaguuu

SEQ ID NO: 34375 - RNA, 21 nt, Artificial Sequence
  Description of Artificial Sequence: Synthetic oligonucleotide
ugggaacacaagucgagaguu

SEQ ID NO: 34376 - RNA, 21 nt, Artificial Sequence
  Description of Artificial Sequence: Synthetic oligonucleotide
uggggaacacaagucgagauu

SEQ ID NO: 34377 - RNA, 21 nt, Artificial Sequence
  Description of Artificial Sequence: Synthetic oligonucleotide
ucggggaacacaagucgaguu

SEQ ID NO: 34378 - RNA, 21 nt, Artificial Sequence
  Description of Artificial Sequence: Synthetic oligonucleotide
ugcggggaacacaagucgauu

SEQ ID NO: 34379 - RNA, 21 nt, Artificial Sequence
  Description of Artificial Sequence: Synthetic oligonucleotide
uagcggggaacacaagucguu

SEQ ID NO: 34380 - RNA, 21 nt, Artificial Sequence
  Description of Artificial Sequence: Synthetic oligonucleotide
ugagcggggaacacaagucuu

SEQ ID NO: 34381 - RNA, 21 nt, Artificial Sequence
  Description of Artificial Sequence: Synthetic oligonucleotide
uggagcggggaacacaaguuu

SEQ ID NO: 34382 - RNA, 21 nt, Artificial Sequence
  Description of Artificial Sequence: Synthetic oligonucleotide
uaggagcggggaacacaaguu

SEQ ID NO: 34383 - RNA, 21 nt, Artificial Sequence
  Description of Artificial Sequence: Synthetic oligonucleotide
ugaggagcggggaacacaauu

SEQ ID NO: 34384 - RNA, 21 nt, Artificial Sequence
  Description of Artificial Sequence: Synthetic oligonucleotide
uggaggagcggggaacacauu

SEQ ID NO: 34385 - RNA, 21 nt, Artificial Sequence
  Description of Artificial Sequence: Synthetic oligonucleotide
ugggaggagcggggaacacuu

SEQ ID NO: 34386 - RNA, 21 nt, Artificial Sequence
  Description of Artificial Sequence: Synthetic oligonucleotide
uagggaggagcggggaacauu

SEQ ID NO: 34387 - RNA, 21 nt, Artificial Sequence
  Description of Artificial Sequence: Synthetic oligonucleotide
ucagggaggagcggggaacuu

SEQ ID NO: 34388 - RNA, 21 nt, Artificial Sequence
  Description of Artificial Sequence: Synthetic oligonucleotide
uucagggaggagcggggaauu

SEQ ID NO: 34389 - RNA, 21 nt, Artificial Sequence
  Description of Artificial Sequence: Synthetic oligonucleotide
ugucagggaggagcggggauu

SEQ ID NO: 34390 - RNA, 21 nt, Artificial Sequence
  Description of Artificial Sequence: Synthetic oligonucleotide
uggucagggaggagcgggguu

SEQ ID NO: 34391 - RNA, 21 nt, Artificial Sequence
  Description of Artificial Sequence: Synthetic oligonucleotide
uaggucagggaggagcggguu

SEQ ID NO: 34392 - RNA, 21 nt, Artificial Sequence
  Description of Artificial Sequence: Synthetic oligonucleotide
uaaggucagggaggagcgguu

SEQ ID NO: 34393 - RNA, 21 nt, Artificial Sequence
  Description of Artificial Sequence: Synthetic oligonucleotide
ugaaggucagggaggagcguu

SEQ ID NO: 34394 - RNA, 21 nt, Artificial Sequence
  Description of Artificial Sequence: Synthetic oligonucleotide
uggaaggucagggaggagcuu

SEQ ID NO: 34395 - RNA, 21 nt, Artificial Sequence
  Description of Artificial Sequence: Synthetic oligonucleotide
uaggaaggucagggaggaguu

SEQ ID NO: 34396 - RNA, 21 nt, Artificial Sequence
  Description of Artificial Sequence: Synthetic oligonucleotide
ugaggaaggucagggaggauu

SEQ ID NO: 34397 - RNA, 21 nt, Artificial Sequence
  Description of Artificial Sequence: Synthetic oligonucleotide
uggaggaaggucagggagguu

SEQ ID NO: 34398 - RNA, 21 nt, Artificial Sequence
  Description of Artificial Sequence: Synthetic oligonucleotide
ugggaggaaggucagggaguu

SEQ ID NO: 34399 - RNA, 21 nt, Artificial Sequence
  Description of Artificial Sequence: Synthetic oligonucleotide
uggggaggaaggucagggauu

SEQ ID NO: 34400 - RNA, 21 nt, Artificial Sequence
  Description of Artificial Sequence: Synthetic oligonucleotide
uaggggaggaaggucaggguu

SEQ ID NO: 34401 - RNA, 21 nt, Artificial Sequence
  Description of Artificial Sequence: Synthetic oligonucleotide
ugaggggaggaaggucagguu

SEQ ID NO: 34402 - RNA, 21 nt, Artificial Sequence
  Description of Artificial Sequence: Synthetic oligonucleotide
uggaggggaggaaggucaguu

SEQ ID NO: 34403 - RNA, 21 nt, Artificial Sequence
  Description of Artificial Sequence: Synthetic oligonucleotide
ugggaggggaggaaggucauu

SEQ ID NO: 34404 - RNA, 21 nt, Artificial Sequence
  Description of Artificial Sequence: Synthetic oligonucleotide
uggggaggggaggaaggucuu

SEQ ID NO: 34405 - RNA, 21 nt, Artificial Sequence
  Description of Artificial Sequence: Synthetic oligonucleotide
uaggggaggggaggaagguuu

SEQ ID NO: 34406 - RNA, 21 nt, Artificial Sequence
  Description of Artificial Sequence: Synthetic oligonucleotide
uaaggggaggggaggaagguu

SEQ ID NO: 34407 - RNA, 21 nt, Artificial Sequence
  Description of Artificial Sequence: Synthetic oligonucleotide
uaaaggggaggggaggaaguu

SEQ ID NO: 34408 - RNA, 21 nt, Artificial Sequence
  Description of Artificial Sequence: Synthetic oligonucleotide
ugaaaggggaggggaggaauu

SEQ ID NO: 34409 - RNA, 21 nt, Artificial Sequence
  Description of Artificial Sequence: Synthetic oligonucleotide
uugaaaggggaggggaggauu

SEQ ID NO: 34410 - RNA, 21 nt, Artificial Sequence
  Description of Artificial Sequence: Synthetic oligonucleotide
ugugaaaggggaggggagguu

SEQ ID NO: 34411 - RNA, 21 nt, Artificial Sequence
  Description of Artificial Sequence: Synthetic oligonucleotide
uagugaaaggggaggggaguu

SEQ ID NO: 34412 - RNA, 21 nt, Artificial Sequence
  Description of Artificial Sequence: Synthetic oligonucleotide
ugagugaaaggggaggggauu

SEQ ID NO: 34413 - RNA, 21 nt, Artificial Sequence
  Description of Artificial Sequence: Synthetic oligonucleotide
uugagugaaaggggagggguu

SEQ ID NO: 34414 - RNA, 21 nt, Artificial Sequence
  Description of Artificial Sequence: Synthetic oligonucleotide
uuugagugaaaggggaggguu

SEQ ID NO: 34415 - RNA, 21 nt, Artificial Sequence
  Description of Artificial Sequence: Synthetic oligonucleotide
uauugagugaaaggggagguu

SEQ ID NO: 34416 - RNA, 21 nt, Artificial Sequence
  Description of Artificial Sequence: Synthetic oligonucleotide
uaauugagugaaaggggaguu

SEQ ID NO: 34417 - RNA, 21 nt, Artificial Sequence
  Description of Artificial Sequence: Synthetic oligonucleotide
ugaauugagugaaaggggauu

SEQ ID NO: 34418 - RNA, 21 nt, Artificial Sequence
  Description of Artificial Sequence: Synthetic oligonucleotide
uagaauugagugaaagggguu

SEQ ID NO: 34419 - RNA, 21 nt, Artificial Sequence
  Description of Artificial Sequence: Synthetic oligonucleotide
ugagaauugagugaaaggguu

SEQ ID NO: 34420 - RNA, 21 nt, Artificial Sequence
  Description of Artificial Sequence: Synthetic oligonucleotide
uugagaauugagugaaagguu

SEQ ID NO: 34421 - RNA, 21 nt, Artificial Sequence
  Description of Artificial Sequence: Synthetic oligonucleotide
ugugagaauugagugaaaguu

SEQ ID NO: 34422 - RNA, 21 nt, Artificial Sequence
  Description of Artificial Sequence: Synthetic oligonucleotide
uggugagaauugagugaaauu

SEQ ID NO: 34423 - RNA, 21 nt, Artificial Sequence
  Description of Artificial Sequence: Synthetic oligonucleotide
uuggugagaauugagugaauu

SEQ ID NO: 34424 - RNA, 21 nt, Artificial Sequence
  Description of Artificial Sequence: Synthetic oligonucleotide
uuuggugagaauugagugauu

SEQ ID NO: 34425 - RNA, 21 nt, Artificial Sequence
  Description of Artificial Sequence: Synthetic oligonucleotide
uguuggugagaauugaguguu

SEQ ID NO: 34426 - RNA, 21 nt, Artificial Sequence
  Description of Artificial Sequence: Synthetic oligonucleotide
uaguuggugagaauugaguuu

SEQ ID NO: 34427 - RNA, 21 nt, Artificial Sequence
  Description of Artificial Sequence: Synthetic oligonucleotide
ugaguuggugagaauugaguu

SEQ ID NO: 34428 - RNA, 21 nt, Artificial Sequence
  Description of Artificial Sequence: Synthetic oligonucleotide
uagaguuggugagaauugauu

SEQ ID NO: 34429 - RNA, 21 nt, Artificial Sequence
  Description of Artificial Sequence: Synthetic oligonucleotide
uaagaguuggugagaauuguu

SEQ ID NO: 34430 - RNA, 21 nt, Artificial Sequence
  Description of Artificial Sequence: Synthetic oligonucleotide
uaaagaguuggugagaauuuu

SEQ ID NO: 34431 - RNA, 21 nt, Artificial Sequence
  Description of Artificial Sequence: Synthetic oligonucleotide
ugaaagaguuggugagaauuu

SEQ ID NO: 34432 - RNA, 21 nt, Artificial Sequence
  Description of Artificial Sequence: Synthetic oligonucleotide
uagaaagaguuggugagaauu

SEQ ID NO: 34433 - RNA, 21 nt, Artificial Sequence
  Description of Artificial Sequence: Synthetic oligonucleotide
ugagaaagaguuggugagauu

SEQ ID NO: 34434 - RNA, 21 nt, Artificial Sequence
  Description of Artificial Sequence: Synthetic oligonucleotide
uagagaaagaguuggugaguu

SEQ ID NO: 34435 - RNA, 21 nt, Artificial Sequence
  Description of Artificial Sequence: Synthetic oligonucleotide
ugagagaaagaguuggugauu

SEQ ID NO: 34436 - RNA, 21 nt, Artificial Sequence
  Description of Artificial Sequence: Synthetic oligonucleotide
uagagagaaagaguugguguu

SEQ ID NO: 34437 - RNA, 21 nt, Artificial Sequence
  Description of Artificial Sequence: Synthetic oligonucleotide
ugagagagaaagaguugguuu

SEQ ID NO: 34438 - RNA, 21 nt, Artificial Sequence
  Description of Artificial Sequence: Synthetic oligonucleotide
uagagagagaaagaguugguu

SEQ ID NO: 34439 - RNA, 21 nt, Artificial Sequence
  Description of Artificial Sequence: Synthetic oligonucleotide
ucagagagagaaagaguuguu

SEQ ID NO: 34440 - RNA, 21 nt, Artificial Sequence
  Description of Artificial Sequence: Synthetic oligonucleotide
uccagagagagaaagaguuuu

SEQ ID NO: 34441 - RNA, 21 nt, Artificial Sequence
  Description of Artificial Sequence: Synthetic oligonucleotide
uaccagagagagaaagaguuu

SEQ ID NO: 34442 - RNA, 21 nt, Artificial Sequence
  Description of Artificial Sequence: Synthetic oligonucleotide
ucaccagagagagaaagaguu

SEQ ID NO: 34443 - RNA, 21 nt, Artificial Sequence
  Description of Artificial Sequence: Synthetic oligonucleotide
uacaccagagagagaaagauu

SEQ ID NO: 34444 - RNA, 21 nt, Artificial Sequence
  Description of Artificial Sequence: Synthetic oligonucleotide
uaacaccagagagagaaaguu

SEQ ID NO: 34445 - RNA, 21 nt, Artificial Sequence
  Description of Artificial Sequence: Synthetic oligonucleotide
uaaacaccagagagagaaauu

SEQ ID NO: 34446 - RNA, 21 nt, Artificial Sequence
  Description of Artificial Sequence: Synthetic oligonucleotide
uaaaacaccagagagagaauu

SEQ ID NO: 34447 - RNA, 21 nt, Artificial Sequence
  Description of Artificial Sequence: Synthetic oligonucleotide
ugaaaacaccagagagagauu

SEQ ID NO: 34448 - RNA, 21 nt, Artificial Sequence
  Description of Artificial Sequence: Synthetic oligonucleotide
uagaaaacaccagagagaguu

SEQ ID NO: 34449 - RNA, 21 nt, Artificial Sequence
  Description of Artificial Sequence: Synthetic oligonucleotide
ugagaaaacaccagagagauu

SEQ ID NO: 34450 - RNA, 21 nt, Artificial Sequence
  Description of Artificial Sequence: Synthetic oligonucleotide
uggagaaaacaccagagaguu

SEQ ID NO: 34451 - RNA, 21 nt, Artificial Sequence
  Description of Artificial Sequence: Synthetic oligonucleotide
uaggagaaaacaccagagauu

SEQ ID NO: 34452 - RNA, 21 nt, Artificial Sequence
  Description of Artificial Sequence: Synthetic oligonucleotide
uaaggagaaaacaccagaguu

SEQ ID NO: 34453 - RNA, 21 nt, Artificial Sequence
  Description of Artificial Sequence: Synthetic oligonucleotide
uaaaggagaaaacaccagauu

SEQ ID NO: 34454 - RNA, 21 nt, Artificial Sequence
  Description of Artificial Sequence: Synthetic oligonucleotide
uaaaaggagaaaacaccaguu

SEQ ID NO: 34455 - RNA, 21 nt, Artificial Sequence
  Description of Artificial Sequence: Synthetic oligonucleotide
ugaaaaggagaaaacaccauu

SEQ ID NO: 34456 - RNA, 21 nt, Artificial Sequence
  Description of Artificial Sequence: Synthetic oligonucleotide
uagaaaaggagaaaacaccuu

SEQ ID NO: 34457 - RNA, 21 nt, Artificial Sequence
  Description of Artificial Sequence: Synthetic oligonucleotide
ugagaaaaggagaaaacacuu

SEQ ID NO: 34458 - RNA, 21 nt, Artificial Sequence
  Description of Artificial Sequence: Synthetic oligonucleotide
ucgagaaaaggagaaaacauu

SEQ ID NO: 34459 - RNA, 21 nt, Artificial Sequence
  Description of Artificial Sequence: Synthetic oligonucleotide
uacgagaaaaggagaaaacuu

SEQ ID NO: 34460 - RNA, 21 nt, Artificial Sequence
  Description of Artificial Sequence: Synthetic oligonucleotide
uuacgagaaaaggagaaaauu

SEQ ID NO: 34461 - RNA, 21 nt, Artificial Sequence
  Description of Artificial Sequence: Synthetic oligonucleotide
uuuacgagaaaaggagaaauu

SEQ ID NO: 34462 - RNA, 21 nt, Artificial Sequence
  Description of Artificial Sequence: Synthetic oligonucleotide
uuuuacgagaaaaggagaauu

SEQ ID NO: 34463 - RNA, 21 nt, Artificial Sequence
  Description of Artificial Sequence: Synthetic oligonucleotide
uguuuacgagaaaaggagauu

SEQ ID NO: 34464 - RNA, 21 nt, Artificial Sequence
  Description of Artificial Sequence: Synthetic oligonucleotide
uaguuuacgagaaaaggaguu

SEQ ID NO: 34465 - RNA, 21 nt, Artificial Sequence
  Description of Artificial Sequence: Synthetic oligonucleotide
uaaguuuacgagaaaaggauu

SEQ ID NO: 34466 - RNA, 21 nt, Artificial Sequence
  Description of Artificial Sequence: Synthetic oligonucleotide
uaaaguuuacgagaaaagguu

SEQ ID NO: 34467 - RNA, 21 nt, Artificial Sequence
  Description of Artificial Sequence: Synthetic oligonucleotide
ucaaaguuuacgagaaaaguu

SEQ ID NO: 34468 - RNA, 21 nt, Artificial Sequence
  Description of Artificial Sequence: Synthetic oligonucleotide
ugcaaaguuuacgagaaaauu

SEQ ID NO: 34469 - RNA, 21 nt, Artificial Sequence
  Description of Artificial Sequence: Synthetic oligonucleotide
uggcaaaguuuacgagaaauu

SEQ ID NO: 34470 - RNA, 21 nt, Artificial Sequence
  Description of Artificial Sequence: Synthetic oligonucleotide
ucggcaaaguuuacgagaauu

SEQ ID NO: 34471 - RNA, 21 nt, Artificial Sequence
  Description of Artificial Sequence: Synthetic oligonucleotide
ugcggcaaaguuuacgagauu

SEQ ID NO: 34472 - RNA, 21 nt, Artificial Sequence
  Description of Artificial Sequence: Synthetic oligonucleotide
uggcggcaaaguuuacgaguu

SEQ ID NO: 34473 - RNA, 21 nt, Artificial Sequence
  Description of Artificial Sequence: Synthetic oligonucleotide
uaggcggcaaaguuuacgauu

SEQ ID NO: 34474 - RNA, 21 nt, Artificial Sequence
  Description of Artificial Sequence: Synthetic oligonucleotide
uuaggcggcaaaguuuacguu

SEQ ID NO: 34475 - RNA, 21 nt, Artificial Sequence
  Description of Artificial Sequence: Synthetic oligonucleotide
uauaggcggcaaaguuuacuu

SEQ ID NO: 34476 - RNA, 21 nt, Artificial Sequence
  Description of Artificial Sequence: Synthetic oligonucleotide
ucauaggcggcaaaguuuauu

SEQ ID NO: 34477 - RNA, 21 nt, Artificial Sequence
  Description of Artificial Sequence: Synthetic oligonucleotide
uucauaggcggcaaaguuuuu

SEQ ID NO: 34478 - RNA, 21 nt, Artificial Sequence
  Description of Artificial Sequence: Synthetic oligonucleotide
ucucauaggcggcaaaguuuu

SEQ ID NO: 34479 - RNA, 21 nt, Artificial Sequence
  Description of Artificial Sequence: Synthetic oligonucleotide
ugcucauaggcggcaaaguuu

SEQ ID NO: 34480 - RNA, 21 nt, Artificial Sequence
  Description of Artificial Sequence: Synthetic oligonucleotide
uugcucauaggcggcaaaguu

SEQ ID NO: 34481 - RNA, 21 nt, Artificial Sequence
  Description of Artificial Sequence: Synthetic oligonucleotide
ucugcucauaggcggcaaauu

SEQ ID NO: 34482 - RNA, 21 nt, Artificial Sequence
  Description of Artificial Sequence: Synthetic oligonucleotide
ugcugcucauaggcggcaauu

SEQ ID NO: 34483 - RNA, 21 nt, Artificial Sequence
  Description of Artificial Sequence: Synthetic oligonucleotide
uggcugcucauaggcggcauu

SEQ ID NO: 34484 - RNA, 21 nt, Artificial Sequence
  Description of Artificial Sequence: Synthetic oligonucleotide
uuggcugcucauaggcggcuu

SEQ ID NO: 34485 - RNA, 21 nt, Artificial Sequence
  Description of Artificial Sequence: Synthetic oligonucleotide
uguggcugcucauaggcgguu

SEQ ID NO: 34486 - RNA, 21 nt, Artificial Sequence
  Description of Artificial Sequence: Synthetic oligonucleotide
uuguggcugcucauaggcguu

SEQ ID NO: 34487 - RNA, 21 nt, Artificial Sequence
  Description of Artificial Sequence: Synthetic oligonucleotide
uauguggcugcucauaggcuu

SEQ ID NO: 34488 - RNA, 21 nt, Artificial Sequence
  Description of Artificial Sequence: Synthetic oligonucleotide
uaauguggcugcucauagguu

SEQ ID NO: 34489 - RNA, 21 nt, Artificial Sequence
  Description of Artificial Sequence: Synthetic oligonucleotide
ucaauguggcugcucauaguu

SEQ ID NO: 34490 - RNA, 21 nt, Artificial Sequence
  Description of Artificial Sequence: Synthetic oligonucleotide
ugcaauguggcugcucauauu

SEQ ID NO: 34491 - RNA, 21 nt, Artificial Sequence
  Description of Artificial Sequence: Synthetic oligonucleotide
uggcaauguggcugcucauuu

SEQ ID NO: 34492 - RNA, 21 nt, Artificial Sequence
  Description of Artificial Sequence: Synthetic oligonucleotide
uaggcaauguggcugcucauu

SEQ ID NO: 34493 - RNA, 21 nt, Artificial Sequence
  Description of Artificial Sequence: Synthetic oligonucleotide
uaaggcaauguggcugcucuu

SEQ ID NO: 34494 - RNA, 21 nt, Artificial Sequence
  Description of Artificial Sequence: Synthetic oligonucleotide
uuaaggcaauguggcugcuuu

SEQ ID NO: 34495 - RNA, 21 nt, Artificial Sequence
  Description of Artificial Sequence: Synthetic oligonucleotide
uguaaggcaauguggcugcuu

SEQ ID NO: 34496 - RNA, 21 nt, Artificial Sequence
  Description of Artificial Sequence: Synthetic oligonucleotide
uaguaaggcaauguggcuguu

SEQ ID NO: 34497 - RNA, 21 nt, Artificial Sequence
  Description of Artificial Sequence: Synthetic oligonucleotide
ucaguaaggcaauguggcuuu

SEQ ID NO: 34498 - protein, 16 aa, Artificial Sequence
  Description of Artificial Sequence: Synthetic peptide
AAVALLPAVLLALLAP

SEQ ID NO: 34499 - protein, 11 aa, Unknown
  Description of Unknown: RFGF analogue sequence
AALLPVLLAAP

SEQ ID NO: 34500 - protein, 13 aa, Human immunodeficiency virus
GRKKRRQRRRPPQ

SEQ ID NO: 34501 - protein, 15 aa, Drosophila sp.
RQIKIWFQNRRMKWK

SEQ ID NO: 34502 - DNA, 21 bp, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
nnnnnnnnnnnnnnnnnnnnn

SEQ ID NO: 34503 - DNA, 21 bp, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(7): 2' O-methyl modified nucleoside
  modified_base (8)..(8): 2' fluoro-modified nucleoside
  modified_base (9)..(9): 2' O-methyl modified nucleoside
  modified_base (10)..(10): 2' fluoro-modified nucleoside
  modified_base (11)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(17): 2' O-methyl modified nucleoside
  modified_base (18)..(18): 2' fluoro-modified nucleoside
  modified_base (19)..(21): 2' O-methyl modified nucleoside
  misc_feature (19)..(21): Phosphorothioate linkage
nnnnnnnnnnnnnnnnnnnnn

SEQ ID NO: 34504 - DNA, 21 bp, Artificial Sequence
  Description of Artificial Sequence: Synthetic oligonucleotide
  modified_base (1)..(4): 2' O-methyl modified nucleoside
  misc_feature (1)..(3): Phosphorothioate linkage
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(21): 2' O-methyl modified nucleoside
  misc_feature (19)..(21): Phosphorothioate linkage
nnnnnnnnnnnnnnnnnnnnn

SEQ ID NO: 34505 - DNA, 21 bp, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(5): 2' O-methyl modified nucleoside
  modified_base (6)..(6): 2' fluoro-modified nucleoside
  modified_base (7)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(21): 2' O-methyl modified nucleoside
  misc_feature (19)..(21): Phosphorothioate linkage
nnnnnnnnnnnnnnnnnnnnn

SEQ ID NO: 34506 - DNA, 20 bp, Artificial Sequence
  Description of Artificial Sequence: Synthetic oligonucleotide
  modified_base (1)..(5): 2'O-methyl or 2'O-methoxyethyl-modified nucleoside
  misc_feature (1)..(20): Phosphorothioate linkage
  modified_base (6)..(15): Any deoxynucleotide
  modified_base (16)..(20): 2'O-methyl or 2'O-methoxyethyl-modified nucleoside
nnnnnnnnnnnnnnnnnnnn

SEQ ID NO: 34507 - DNA, 21 bp, Artificial Sequence
  Description of Artificial Sequence: Synthetic oligonucleotide
  modified_base (1)..(4): 2' O-methyl modified nucleoside
  misc_feature (1)..(3): Phosphorothioate linkage
  modified_base (5)..(5): 2' fluoro-modified nucleoside
  modified_base (6)..(6): 2' O-methyl modified nucleoside
  modified_base (7)..(7): 2' fluoro-modified nucleoside
  modified_base (8)..(8): 2' O-methyl modified nucleoside
  modified_base (9)..(9): 2' fluoro-modified nucleoside
  modified_base (10)..(21): 2' O-methyl modified nucleoside
  misc_feature (19)..(21): Phosphorothioate linkage
nnnnnnnnnnnnnnnnnnnnn

SEQ ID NO: 34508 - DNA, 22 bp, Artificial Sequence
  Description of Artificial Sequence: Synthetic oligonucleotide
  modified_base (1)..(1): 2' fluoro-modified nucleoside
  misc_feature (1)..(3): Phosphorothioate linkage
  modified_base (2)..(2): 2' O-methyl modified nucleoside
  modified_base (3)..(3): 2' fluoro-modified nucleoside
  modified_base (4)..(4): 2' O-methyl modified nucleoside
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(10): 2' O-methyl modified nucleoside
  modified_base (11)..(11): 2' fluoro-modified nucleoside
  modified_base (12)..(12): 2' O-methyl modified nucleoside
  modified_base (13)..(13): 2' fluoro-modified nucleoside
  modified_base (14)..(14): 2' O-methyl modified nucleoside
  modified_base (15)..(15): 2' fluoro-modified nucleoside
  modified_base (16)..(16): 2' O-methyl modified nucleoside
  modified_base (17)..(17): 2' fluoro-modified nucleoside
  modified_base (18)..(18): 2' O-methyl modified nucleoside
  modified_base (19)..(19): 2' fluoro-modified nucleoside
  misc_feature (19)..(21): Phosphorothioate linkage
  modified_base (20)..(21): 2' O-methyl modified nucleoside
  modified_base (22)..(22): a, c, t, g, unknown or other
  3'-lipid modified
  See specification as filed for detailed description of substitutions and preferred embodiments
nnnnnnnnnnnnnnnnnnnnnn

SEQ ID NO: 34509 - DNA, 22 bp, Artificial Sequence
  Description of Artificial Sequence: Synthetic oligonucleotide
  modified_base (1)..(4): 2' O-methyl modified nucleoside
  misc_feature (1)..(3): Phosphorothioate linkage
  modified_base (5)..(5): 2' fluoro-modified nucleoside
  modified_base (6)..(6): 2' O-methyl modified nucleoside
  modified_base (7)..(9): 2' fluoro-modified nucleoside
  modified_base (10)..(21): 2' O-methyl modified nucleoside
  misc_feature (19)..(21): Phosphorothioate linkage
  modified_base (22)..(22): a, c, t, g, unknown or other
  3'-lipid modified
  See specification as filed for detailed description of substitutions and preferred embodiments
nnnnnnnnnnnnnnnnnnnnnn

SEQ ID NO: 34510 - DNA, 21 bp, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(5): 2' O-methyl modified nucleoside
  modified_base (6)..(6): 2' fluoro-modified nucleoside
  modified_base (7)..(7): 2' O-methyl modified nucleoside
  modified_base (8)..(9): 2' fluoro-modified nucleoside
  modified_base (10)..(13): 2' O-methyl modified nucleoside
  modified_base (14)..(14): 2' fluoro-modified nucleoside
  modified_base (15)..(15): 2' O-methyl modified nucleoside
  modified_base (16)..(16): 2' fluoro-modified nucleoside
  modified_base (17)..(21): 2' O-methyl modified nucleoside
  misc_feature (19)..(21): Phosphorothioate linkage
nnnnnnnnnnnnnnnnnnnnn

SEQ ID NO: 34511 - DNA, 21 bp, Artificial Sequence
  Description of Artificial Sequence: Synthetic oligonucleotide
  modified_base (1)..(1): 2' O-methyl modified nucleoside
  misc_feature (1)..(3): Phosphorothioate linkage
  modified_base (2)..(2): 2' fluoro-modified nucleoside
  modified_base (3)..(3): 2' O-methyl modified nucleoside
  modified_base (4)..(4): 2' fluoro-modified nucleoside
  modified_base (5)..(5): 2' O-methyl modified nucleoside
  modified_base (6)..(6): 2' fluoro-modified nucleoside
  modified_base (7)..(13): 2' O-methyl modified nucleoside
  modified_base (14)..(14): 2' fluoro-modified nucleoside
  modified_base (15)..(15)<<223> 2' O-methyl modified nucleoside
  modified_base (16)..(16): 2' fluoro-modified nucleoside
  modified_base (17)..(21): 2' O-methyl modified nucleoside
  misc_feature (19)..(21): Phosphorothioate linkage
nnnnnnnnnnnnnnnnnnnnn
